United States Patent 11,739,335 (NUCLEIC ACIDS ENCODING CRISPR-ASSOCIATED PROTEINS AND USES THEREOF) - sequence listing, part 3

SEQ ID NO: 2191 - RNA, 4299 nt, Artificial Sequence
  Cas9 variant
augaagaagauccugggccucgaccuggggagcaacuccaucggcugggcccuggugaacgaggccgagaacagcgacgaggucuccagcaucaucaagcucggggugcgcgugaacccccugaccgucgacgagaugcagaacuucgagaagggcaaguccaucaccacgaacgcggaccggacccugaagcgcagcaugcggcgcaaccuccagcgguacaagcugcgccgggacgcccugaucaagcuccugaagaaggugggguucaucaccgacggcaccauccuguccgagcagggcaaccgcacgaccuucgagaccuaccggcuccgcgccaaggccccggacgaggagaucagccugcaggagcuggcccgggugcuccugaugaucaacaagaagcgcggguacaaguccagccggaagaucaaggagaaggaggcgggcacccugaucgacgggauggaggucgccaagaagcucuacgacgaggaccugacgcccggccagcugugccuccagcugcuggaguccgggaagaagucccuccccgacuucuacagcagcgaccugcaggaggaguucgaccgcaucuggaacuuccagaagcaguucaaccccaaggccuucugcgacaccgccaaggaggagaucaagggcaagaacaagucccagaccugggcgauccuggccaaguacuucaucuggaccgacgagauggugguguggaacgagaaggagagcaagacggagcgggucgagaaggagugcaagcucgugggccugaagcgcaccgugaagaaggaggagcagcggaaggagaacuacugcuggcgcguccaggcccugaccgagcagcucgaccuggagaagguggccgugguccugcaggagaucaacgggcagaucuccaccagcuccggcuaccucggggccaucagcgaccggagcaaggugcuguacuucaaccgccagacggugggccaguaccagauggcggagcuggagaagaacccgaacaccucccuccggaacauggucuucuaccgccaggacuaccuggacgaguucgacaagaucugggagaagcaggccgaguuccacaaggagcugaccguggagcucaagaaggagauccgcgacaucaucaucuucuaccagcggcgccucaagagccagaagggccugaucggguucugcgaguucgagaaccgggagaucaugguggagaagaacggcaagaugcaggccaaggucguggggugcaaggugaucccccgcucccacccccucuuccaggaguucaagaucuggcagacccugaacaacgucgagguguucgccggcgagaagaagugcaagcggaagcgcacggacgccuuccccgggcuguucgacggcaccgaggacacccucauggucgagggcuggcgguaccuguaccaggaggagaaggagauccuggcgaaggagcucagcgugaagaagucccugaagaaggaguacauccugaagcugcuguucgacaacccgcaggaccuggacaugaacuucgagcagaucgaggggaacgacaccggcaacgugcuguucagcgccuacuccaagaugaucgagaaguacggguacgagccccucgacuucggcaagcccacggacaagaucaucgagcagcugcaggucaucuucgccgaccugggguggaacaccgaccuccuguucguggaccugaacaaggagggcaaggaccucgagaagcagcccuacuucaagcuguggcaccuccuguacagcuucgagggcgacaacaccccgaccgggaacggcaagcugguggagaagcugauggagcucugccacgucgggaaggagugcgcccuggagcuggugaacaucuccuuccagaacgacuacggcagccucuccgccaaggcgaucaagaagauccugcccuaccugaaggaggggaaccgcuacgacguggccugcggcuacgccggcuaccggcacagcaaguccagccucacgaaggaggagaucgagaacaagguccugaaggacaagcuggacauccuccccaagaacucccugcgcaaccccgugguggagaagauccugaaccagauggucaacgugaucaacgccaucaucgacaccuacgggaagccggacgagauccggguggagcucgcccgcgagcugaagaaguccgcgaaggagcgggaggagcugaccaaggccaucgccaagagcacccgcgagcacgaggagauccggaagguccuccaggaggaguucggcaugaucaacgugagccgcaacgacaucauccgguacaagcuguacgaggagcugaaggacaacggguacaagacgcucuacuccaaccaguacauccccaaggagaagguguucagcaaggagaucgacaucgagcacaucaucccccaggcccgccuguucgacgacagccuguccaacaagacccucgaguacaaggcgaucaacaucgagaagggcaacaagaccgccuacgacuucgucaaggagaaguacggcgagaaggggcugcagcaguaccugaaccggugcgagagccucuucaagggccagcgcaccaagcugcgcaagcugaagauggggcaggagaacauccccgagggcuucaucgaccgggaccuccgcaacacgcaguacaucgccaagaaggcccuggccaugcugaacgagaucugccggcgcgugguggcgaccaccggguccaucaccgaccggcuccgcgaggacuggcagcuggucgacgugcugaaggagcucaaccugccgaaguacgagacccugggccucguggaggucuacgaggacaaggacggccggaagaucaagcgcaucaaggacuggacgaagcggaacgaccaccgccaccacgccauggacgcccugaccguggccuucaccaaggacguguucauccaguacuucaacaacaagaacgccgcguggcaggccgacugcaaggagcacagcgacaucaucgggaucaagacccgguacuucgagaacggccgcucccugccgcccaugccccucguccgguuccgcgccgaggccaagagccaccuggagacgcugcucguguccaucaaggccaagaacaagguggucaccaacaacgugaacugcaccaagcggaagggcggggagaacaagaagcugcagcagagcccccgcgggcagcugcaccucgagaccaucuacggcucccaccggcaguacgugacgaaggaggagaaggucaacgcgagcuucgacuccagcaagaucgccaccgugugcaagcaggccuaccgcaacgcccugcuggagcggcucgcggccuucggcaacgaccccaagaaggccuucaccgggaagaacucccuggagaagaaccccguguaccugaaccgcgagcagaccgcccggguccccgagcgcgugcgcacgguggagcucgagaccgucuacaccauccggaagccgguggaccccaaccugagcguggacaaggucguggacgccaaggugcgcuccauccuggagcagcggcuccgcgaguacgacggcgaggcgaagcgggccuucgucaaccuggacgagaaccccaucuggcugaacgaggagaaggggaucgccaucaagcgcgugaccauccggggcaucaacaaggugcagagccuccacgggaagaaggacaagaacggcaaccugauccuggacgagacgggcaagaagaucccggucgacuucgugaacaccgggaacaaccaccacguggccaucuaccgcaagcccguccucaacaagaccggccaggagaugcuggacaacgaggggaaccccguguacgagcuggacgaggucgugguguccuucuucgaggccgucacccgggugaaccucggccugcccgugaucgacaagaacuacaacaagagcgagggguggcaguucauguucacgaugaagcagaacgaguacuucgucuucccgaacgagaagacccgcuucgaccccaaggagguggaccugcucaaccccgagaacuacgcggugaucagccccaaccuguuccggguccagaagaucaccgagaaggacuacauguuccgccaccaccuggagaccaaggugguggacgacaaguuccucaaggagaucacguggaagcggauccugaccccgaacaagcuggagggcaucgucaaggugcgcgugaaccacaucggccagaucgucuccgugggggaguacuga

SEQ ID NO: 2192 - RNA, 4299 nt, Artificial Sequence
  Cas9 variant
augaagaacauccugggccucgaccuggggaccaccagcaucggcuucgcccacaucguggaggacgagaacaaggagaaguccgagaucaaggagcuggggguccgcaucgugagccucacgaccgacgagcaguccgacuucgagaagggcaagagcaucaccaccaacgccaaccggacgcugaagcacggggcgcgccugaaccucgaccgguaccagcagcgccggaaguaccugaucgaccugcuccacaaggccaaccugaucacccccuccagcauccuggccgagaacggcaagaacaccacccacuccacguggcagcuccgcgccaaggccgugaccgagcggaucgagaaggaggaguucgcgcgcauccugcuggccaucaacaagaagcggggcuacaagagcucccgcaaggccaagaccgaggacgaggggcaggccaucgacggcauggcgaucgccaagcggcucuacgacgagaaccugaccccggggcagcugagccuccagcugcugcagcagaacaagaagcuccugcccgacuucuaccgcuccgaccugcagaaggaguucgaccucgucuggaacuuccagaagcaguucuaccccgacauccugacggacaucuucuacaaggagcugcagggcaaggggaaggacgccaccagcaaggccuucuccaagcgguaccacuucgacaccgccgagaacaagggcagcaaggaguccgugcgccuccaggcguaccaguggcgggccgaggccgugagcaagcagcuguccaaggaggaggucgccuacgugcugaccgagaucaacaacaaccucaacaacgccagcggcuaccugggggcgaucuccgaccgcagcaaggagcuguacuucaaccggcagacggugggccaguaccucuacgcccagcugcaggagaaccgccacaacagccugaagaacaaggucuucuaccggcaggacuaccucgacgaguucgagcgcaucugggagacccaggcccuguuccacaaggagcugaccgacgagcucaagaagcagauccgggacguggugaucuucuaccagcgcaagcccaagucccagaaggggcugaucagcuucugcgaguucgaguccaaggagaucgagaucgagaaggacggcaagaccaucacgaagaacaucggcgcccgcgucgugcccaagagcuccccgcuguuccaggaguucaagaucuggcagauccucaacaacgugaucugcaagcggaaggggauccgcaagaagaagaucagcgccaagaccacccagcuggaccugcucaacgaguccagccagaccaucuucucccuggacauggagugcaagcagcugcuguucgacgagcugaaccugaagggcgaccucaagagcgacaagguccucaagcugcugggguacagcccccaggagugggagaucaacuacaaccagcucgagggcaaccggacgcagaaggcgcuguacgaggccuaccugaagaucguggagauggaggcccacgacgugaaggacauccuccagaucaagagcaccaaggacgacuggucccuggacgagagcccccuguccgccagcgagauccgcgaguccgucaaggccaucuuccaggcgcucgggaucugcaccaagauccuguacuucgacccgcugcuccccgugaaggacuucgaggagcaggacagcuaccagcuguggcaccuccucuacuccuacgagagcgacgacagcaccuccggcaacgagacgcuguaccggauccuggagaagaaguacgccuucaagcgcgagcacgcccggauccucgccaacguggcgcugcaggacgacuacggcagccuguccaccaaggccauccgcaagaucuaccccaacaucaaggagaaccaguacagcaccgccugcgagauggccggguacaagcacuccaagcucagccugaccacggaggagcuggaggcccgggagcucaagaacaucaucccccugcugaagaagaacgcgcuccgcaacccggucguggagaagauccugaaccagaugaucaacguggucaacgcccugaucgagaagaacuccgagcgggacgccgagggcaagaucaccaaguacuuccacuucgacgagauccgcaucgagcucgcccgggagcugaagaagaacgcccagaagcgcuacgagaugacccagaacaucaacaaggcgaaguccgagcaccagaagaucuccgagauccugcagaaggaguucgggaucaagaaccccaccaagagcgacaucauccgguaccgccucuacaaggagcuggagcacaacggcuacaaggagcuguacacgaacaccuacaucgcccccgacgugcuguucuccaagaacaucgacaucgagcacaucguccccaaggcccggguguucgacgacagcuucuccaacaagacccuggccuucaaggacuucaacaucaagaagggggagagcaccgccuucgacuacaucaccucccugaagaacgaggagaagcucaaccaguaccuggcgcgcguggagaacgccuacaagacgaagaacaucagcccggccaaguacaagaaccugcucaagaaggccuccgagaucggcgacggcuucaucaaccgggaccugcgcgacacccaguacaucgcgaagaaggccaaggagauccuguuccaggucaccaagaacgugcucagcaccagcggguccaucacggaccgccugcgggaggacuggagccugguggacgucaugaaggagcucaacaugcccaaguaccagucccugggccugaccgagguggaggagcgcaaggacgggaacaaggugaccgucaucaaggacuggaccaagcggaacgaccaccgccaccacgccauggacgcccucacgguggccuucaccaagcccagcuacauccaguaccugaaccaccugaacgcgcggaaggacgagaacaacaagaacuacuccgugauccucgccaucgagaagaaggagaccaucaagguccccaccaacaacggcaagaacaagcgcguguucaucgagccgauccccaacuuccgccagguggccaagaagcaccuggaggagaucuucaucagccacaaggccaagaacaaggucgugacgaagaacaccaacaagcccgccgggaccaacaagcagcagaucacccugacgccccggggccagcuccacaaggagaccaucuacggcaaguaccaguacuacgugaacaaggaggagaaggucggggugaaguucgacaaggagaccaucgcgaagguguccaacccgcuguaccgggaggcccugcucaagcgccugcaggccaacgacaacgaccccaagaaggccuucaccggcaagaacgcccugagcaagaaccccaucuaccucgacgaggcgaagacgaagacccugcccgagaaggucaaccugaccuaccucgaggaggacuucuccgugcggaagaagaucgugccgaagaaccccaccagcaaggaguucguccccaaccugaaguccaucgagaaggugguggacgaggggguccgcaacauccugaucgagcggcuccgcguguacaacaacgacccggagaaggccuucguggaccuggagaagaaccccaucuggcugaacaaggagaagggcaucgccaucaagcgggucacgaucagcggcgugaacaacgcccagccccuccacaucgggaaggaccaccugggcaagaccacccugaacaaggaggggaaggagauccccguggacuacgucuccaccggcaacaaccaccacguggcgaucuaccgcgacaaggaggggaaccuccaggagcagaucgugagcuucuucgaggccgucgugcggacgcagcagggccugccgaucaucgacaagaccuacaagcaggaggagggcuggcaguuccuguucaccaugaagcagaacgagauguucguguuccccaacgaggccaccggguucaaccccgccgagaucgaccuccuggaccccaagaacaagaagcagaucuccccgaaccuguuccgcguccagaagaucgccacgaaggacuacuucuuccggcaccaccucgagaccaacguggagaccgacaacgugcugaagaacaccacguggaagcgcgagggccugagcgggcucaaggacaucgucaaggugcggaucaaccaccugggcgacaucguguccaucggggaguacuga

SEQ ID NO: 2193 - RNA, 4302 nt, Artificial Sequence
  Cas9 variant
augaagaagauccugggccuggaccuggggaccaccagcaucggcuacgcccaggugaacgaguccgaggacuucaaggacagcuccaucgagcgcaucgggguccgggugaacccccugagcguggacgagcagacgaacuucgagaagggcaagccgaucuccaucaacgccgaccgcacccucaagagcggggcgcggcgcacccuggaccgguaccaggaccgccgguccaaccugaucgacgcccucgucaagagcgugaucaucaccgaggacacggugcuggccgaggacggcaagaacaccacccacuccaccuucgcccugcgcgccaagagcgcguccgagaaggucgagaaggccgaguucgcccggauccuccuggccaucaacaagaagcgcggcuacaagagcucccggaagacgaacaacaacgacgacgaggggcaggcgaucgacggcauggccaucgccaagaagcuguacgacgagaaccucacccccgggcagcuggccuaccagcugcucaaggagggcaagaaguaccugcccgacuucuaccgcagcgaccugcaggccgaguucgacaagaucuggaccuuccagaagcaguucuaccccgagauccucaccgacgagcugcagaaggagcuggcggggaagggccagcgggccacguccgccaucuucuggaagaaguacgacuucaacaccgccgagaacaagggcacccgcgaggagaagaagcucaaggccuacgaguggcggagcaccuccguggacaagaagcugcagaaggaggagguggcguacgucaucacggagaucaacaacaaccugaccaacagcuccggguaccucggcgccaucagcgaccgcagcaaggagcuguacuucaacaagcagaccguggggcaguaccuguucaagcagauccagaagaacccgcacaccaagcucaagaaccagguguucuaccggcaggacuacuucgacgaguucgagaucaucugggagacgcaggccaaguuccaccccgagcugaccgaggagcugaagaacaagauccgcgacaucaucaucuucuaccagcggaagcucaagucccagaagggccugaucagcuucugcgaguucgagcgcaaggaggucgagaucgagaagggcgggcggcgcaugaagaagaccaucggccugaagguggcccccaaguccagcccccucuuccaggaguucaagaucuggcagguccugaacaacgugcugauccgcaagaagggguccaagaagcggcgcgugaaggagccggaccagcucaaccugguggagcaggagcaggaggucauguucuucgacaugcagaccaagcagacgcuguucgacgagcucaacgugaagggcaaccugaaggccaagcggaucaucgagcugaucgggcaggacgcgaacgacugggagaucaacuacagcgagaucgagggcaaccgcaccaacaaggcccucuacgacgccuaccugaagauccuggaccucgagggcuacgacaccaaggcccugcuggacgugaagaccuccaaggacgaggucgagcucgacgacaucaacaucagcgggcccgaggugaaggaccuggugaagcggaucuucgagucccuggagaucgacacgcagauccuggaguucgacgccgagcucgacggcgaggucuucgagaagcagagcuccuaccugcuguggcaccuccuguacagcuacgagggggacgacucccccagcggcaacgagaagcuguacaagcuccugaagcagaaguucggguucaagaaggagcacgcgcagauccuggccuccaucacccucagcgacgacuacggcucccugagcgccaaggccaugcgcaagaucuaccccuacauccgggagcagaccuucgacaaggcggccucccuggccggcuaccgccacagcgccagcucccucaccaaggaggagaucgccaaccggccgcugaaggacaagcuggagcucaucaagaagaacagccugcgcaaccccguggucgagaagauccugaaccagguggugaacaucgucaacucccucaucgaggcgaacagcgagaaggacuccgacgggaacaucaucagcuacuucaaguucgacgagauccggaucgagcuggcccgcgaccugaagaagaacgccaaggagcgggccgagaugacgcucaacaucaacgccgcgaagaucgugcacgagaagaucuucaagcugcugcaggccgaguucggcgugaagaaccccacccgcaacgacaucauccgguacaagcucuacgaggagcugaagaacaacggguacaaggaccuguacaccaacaucuacaucccccgcgagauccucuucuccaagcagaucgacaucgagcacaucaucccgcagagcaagauguucgacgacuccuucagcaacaagaccaucgucuuccggaaggacaaccuggacaagggcaacuccacggccuucgacuacaucgacagccgcuucgggaaggacaagcugaccgacuucgagcagcggaucgaguuccucuucgagcagggcaagaagaacaaggaggagggcaucuccaaggccaaguaccagaagcugcugaagcgcgaggccgacaucggggacggcuucaucgagcgcgaccuccgggacacccaguacaucgcgaagaaggcccgcaaccugcuguacgagaucugccggaucgugacccccaccacggggagcaucaccgaccgccuccgggaggacugggaccuggugaacaucaugcaggagcugaaccucgacaaguucaagaagcugggccugaccgagauggucgagaagaaggacggcuccuucaaggagcgcaucguggacuggagcaagcggaacgaccaccgccaccacgccauggacgcccucaccaucgcguucacgaagcacucccacauccaguaccugaacuaccugaacgcccggaagaacgagaaccacaagcagcaccacaacaucaucgggaucgagcgcaaggagaccgaguucgugaucgacgaccucggcaacaagaagcggaaguuccaccucccccugcccaacuuccgcgaggaggccaagaagcaccuggagaacguccuggugagcuucaaggccaagaacaagguggucaccaagaacaagaacaagaccgccagcuccaagggggagaagaucaagguggagcugacgccgcggggccagcuccacaaggagaccguguacgggaaguacaaguucuacgucagcaaggaggagcgcaucggcggcaaguucgaccagcggaccaucgagcgcguggcgaacuccacccacaagcggcugcugcuccagcgccugcuggagaacgacaacgacgccaagaaggccuucacggggaagaacgcccucgccaagaaccccaucuaccuggacgacaccaagacccugacccuccccgagaucgugaagcugacguggcuggaggaggacuacagcauccggaaggacaucacccccgagaacuucaaggacaucaaggucaucgacaagauccucgacgagggcgugaagcgcauccugaaggagcggcuggcgaagcacaacaacaacccgaaggaggccuucuccgaccucgagaagaaccccaucuggcugaacgagaagaaguccaucagcaucaagaaggugaagaucagcgggaucaacaacgccgaggcccugcacuacaagaagaaccaccucggcaucgagauccuggacgacgagaagaagcgcauccccgucgacuucguguccaccgggaacaaccaccacguggccaucuaccgcgacgagaagggcaaccugcaggaggacgucgugagcuucuucgaggcgguggcccgggucaaccagaaccuccccaucaucgacaagacccugaaggccuaccugggcuggacguuccucuucaccaugaagcagaacgaguacuucaucuucccgaacaagcagaccggguucaaccccaccgagaucgaccugcuggacuccaugaacaacaagcucaucagccccaaccuguuccgcgugcagaaguucacggugaaggacuacuucuuccggcaccaccuggagaccaacgucgaggacgacuccaagcucaagaacaccaccuggaagcgcgagggccucgggggcaucgggaacaucgugaaggugcggaucaaccacaucggccagaucgucaagaucggcgaguacuga

SEQ ID NO: 2194 - RNA, 4305 nt, Artificial Sequence
  Cas9 variant
augaagaacauccugggccucgaccuggggaccaacagcaucggcugggccuacgugaagcaggcccagaacgacuccgagaaguccgagaucgcggagcuggggguccgcgugaacccccucaccguggacgagaagacgaacuucgagaagggcaagccgaucagcaccaacgccgaccggacccugaagcgcggggcccggcgcaaccugcagcgguacaagcuccgccggcaggagcugaucgagcugcucaaggacuaccaggucaucagcgacaagaccauccuggccgaggacggcaaggagacgaccuucgagacccugcgccuccgggugaaguccgccaaggagcaggucagccuggaggagcuggcgcgcauccuccugaugaucaacaagaagcggggcuacaaguccagccgcaaggccaagaacgaggacgaggggcagcugaucgacggcauggagaucgcccggcgccucuacgacgagaaccugaccacggggcagcugucccuccagcugcugaaggagggcaagaagucccuccccgacuacuaccggagcgaccugcagcacgagcuggacaagguguggaacuuccagaagcaguuccaccccgacauccucaccgacgaguucuacaccagcauccaggggaagggccagaaggccacccgcgaguccuucagcuccaaguacggcaucgacacggcggagaacaaggggagccgggaggagaagaagcugcaggccuaccaguggcgcgccgacgccacccacaaggagcugaccaaggaggagcucgccuucgugaucaccgagaucaacaacaacaucaacaacuccagcggcuaccugggggcgaucuccgaccggagcaaggagcugaucuucgccaacgagacggugggcgaguaccucuggaagcagauccagaacgacccccacaccagccugaagaaccaggucuucuaccgccaggacuacuucgacgaguucgagcggaucugggagacccaguccggcuucuacccgcagauccugaccgagagccucaagaacgagcugcgcgacauccugaucuucuaccagcgcaagcucaagucccagaaggcccuggugagcaucugcgaguucgaguccaaggagaucccccugaaggacaagcaggggaaccccaucagcaagaacggcauccccgugacgaagcucgucgggccgaagguggcccccaaguccagcccccuguuccaggaguucaagaucuggcagaaccugaacaacgugcucguccggcccaagggcucccgcaagcggaaggugaccaccaaccagcagagcacccugcuggaggggcaggagccgguguucgagcucaaccuggagcagaaggagcugcuguucgaggagcucaaccugaagggcaaccugaagacggacuacugccucgagcugaucggcuacuccgccaaggagugggagaugaacuaccccacccuggaggggaacaagaccaacaaggcgcucuacgaggccuaccugaagaucaucgacagcgagggcuacgacgccaagaagcugcucaaggucaagaccgacaaggacgacaucaaccuggacgacaucaagguguccgccagcgagaucaagacgaugaucuccgacaucuucaacgagcuggggaucaacaccaagauccucgacuucgacgccgagcuggagcgcaagcaguucgaggcgcaggccagcuaccggcuguggcaccuccuguacuccuacgagggcgacgacagcaaguccgggaacgagcugcucuaccgccugcuggaggacaaguucggcuucaagcgggagcacagcaagacccucgccaacgugagccugcuguccgacuacggcaaccucagcaccaaggccauccgcacgaucuaccccuacaucaaggagaacaaguucuccaccgccugcgagcuggcgggguaccggcacagcaagcuguccaucagcaaggaggagaacgagaaccgcacccucaaggacacccuggacguccugaagaagaacucccuccggcagcccgugguggagaagauccugaaccagaugaucaaccugaucaacgagcucaucgagaagcacagcgagaaggacgagaagggcaacaucgucaaguacuucaaguucgacgagauccacaucgagcuggcccgcgagcugaagaagaacgccgaggagcggcgcgagcucgacuccaaggugcgggaggggaaggaccgcaacgagaagaucaucacgauccucaagagcgaguucggccugccguaccccaccaagaacgacaucacccgguaccgccucuacgaggagcugaaggacaacggguacaaggaccuguacaccaacaccuacaucccccgggagaagcuguucuccaaggagaucgacaucgagcacaucauccccaagagccgccuguucaacgacuccuucagcaacaagacgaucugcuaccgccaggacaaccugaacaagggcgagcggaccgccuacgacuacaucgagggccucgggaagacccagcuggacgaguaccugaaccgcgucgagaaccucuacaccaacaaguucaucacgaaggcgaaguaccggaaccugcugaagaaggaguccgagaucggcgacggguucaucgagcgcgaccuccgggagacccaguacaucgccaagaaggccaaggagaugcugcugcagaucacccgccacguggugagcaccacgggcuccaucaccgaccggcuccgcgacgacugggagcuggucaacgugaugcgggagcugaaccucccgaaguacaaggugcugggccugaccgagauccaggagcgcaagaacgggcagaccgucgaggugaucacggacuggaccaagcggaacgaccaccgccaccacgccauggacgcccucaccguggcguucaccaagcacagccacauccaguaccugaacuuccugaacgcccggaaggacgagaagcacaaggaguacagcaacaucaugggcauccagcagcucgagacggagaagaccaccgacaaggacgggaaggaccgccgggucuucaagacccccauccccaacuuccgccagguggccaaggagcaccuggaguccauccugaucagccacaagacgaagaacaagguggucacccgggccaccaacaagaucgccggcuccaagaagcagcaggagacccucagcccccgcgggcagcugcacaaggagacgguguacggcaaguaccggcgcuacgugcagaaggaggagaagaucggcuccaaguucgaccugcagaccaucgagcgggucgcgaacccgcucuacaagcgccugcugaccaagcgccucgaggagaacgggggcgaccccaagaaggccuucaccgggaagaacgcccuggccaagagccccaucuaccuggacgagacgcagacccagcagcuccccgagaaggugaagcugguguggcuggagaccgacuucuccauccggaaggacaucaccccggacaacuucaaggacgagaaguccaucgacaagguccucgacgagggcaucaagcgcauccugaaggaccggcucaagagcuucgacggggacgccaagcgcgcguucacggaccuggagcagaaccccaucuggcugaacaaggagaagggcaucgccaucaagcgggugaccaucagcggcguguccaacgccgagccccugcacaccaagaaggaccaccucgggaacgagaucuucgacgacaccggcaagccgauccccgucgacuacgugagcacggggaacaaccaccacaucgccaucuaccgcgacgagaacggcaaccugcaggagaaggcgguguccuucuucgaggccgucacccgggccaaccaggggcugcccaccguggacaagaccuacaaccagcaccucggcuggcaguuccuguucaccaugaagcagaacgagauguucguguuccccaacaaggagacgggcuucgacccgcaggagaucgaccugcucgaccccaagaacaagaagcugaucagccccaaccuguuccgcguccagaagaucuccaccaagaacuacuucuuccggcaccaccucgagaccagcguggagacccacaacgcccugaacggggugacguacaagucccagcugggccugaacgggaucaccgacaucaucaagguccgcaucaaccaccucggcgacaucgugcacaucggggaguacuga

SEQ ID NO: 2195 - RNA, 4308 nt, Artificial Sequence
  Cas9 variant
augcugggcugcgagcgcaagcggaagcgccgggagaaggagaagauggccaagcccaaggacuacaccaucgggcucgacaucggcaccaacagcguggggugggucgugacggacgaccagaacaacauccugcgcaucaagggcaagaaggccaucggggcgcggcuguucaccgagggcaagguggccgccgagcgccgguccuuccgcaccacccggcgccggcucagccgccggcgcuggcggaucaagaugcuggaggagcuguucgacgaggagaucgccaaggucgacccguccuucuucgcccgccuccacgagagcuggaucucccccaaggacaagcggaagcgcuacagcgcgaucguguuccccucccccgaggaggacaagaaguuccacgagagcuacccgacgaucuaccaccuccgggacaagcugaugaaggacgaccagaagcacgacauccgcgagaucuacaucgccgugcaccagaugaucaaggcccggggcaacuuccugcacgacgaguccgucgagaccuaccgcagcgggauguccagccugggcgggcgcuccgagcggaacauccugagcgugcagacccucgaggagcugaacgaccuguucgccgagaacgagggcaccgaggagguggagcucaacgucgcguccgccgagcagaucaacgacauccugaccgggggccaccugaacgccgacagccagaaggagaucuccaaccuccugcugcccagcuccuuccccagcuucgacgacaaggccaaggagaagcaggucaagaagcucaucaacaacguggccacgaacaucagcaaggcguggcugggcuacaaggccgacuucuccaccauccugaaccucgccaagguggacaaggaccagaagaagaucuucgccuucgcccugcagggcggggacgaggaggacaaggugcaggagcuggagagccuccuggagcagucccagaccgacaucguggaccgccugaucgagauccggcacgcgaucguccucagcgagaucgugcccguggggaugacgcuguccgaggccaugaucgacaaguacgaccagcacaaggaggaccugaucacccucaaggccgucauccgcaacaccaaggacaagaagaaggccgccaagcugcaggcgaucuacgaccuguacgugaagaaccggcacgccgaccucgccaaggccaugaagcugaccggcaucaagaagcgcagcgagcugcucgacccggaggagcugaagaagggcaucuccagccugcucgacgacucccccgaggccguggagaucaagcagcggcuggaggagaagacguuccugccccuccagcgcagcaacaacaacggggucauccccaaccagcugcaccagguggagcuggacgagaucaucaagaagcaguccaaguacuacccguuccucgcggagaagaaccccgacgagagcgaggaggcccagaagaaggcccccaccaagcuggacgcccugcugaccuuccgggugcccuacuacgucggcccgaugaucaccaaggaggagcaggaggcgcagaacgggcacuccuucgccuggauggugcgccgggacccccaggaccacgaggccaucacgcccuggaacuucgagaagaaggucgacaagauggccagcgccacccaguucaucaagcgcaugaccaccaaggacacguaccuccugggcgaggacgugcugcccgcguccagccucaaguaccagcuguucaccgugcugaacgagcucaacaaccugcgggucaacgggaagaagcugaccuccgacgagaaggagcaggucaucgagggccucuucaagaagcagaagaccgugaaggccgacaaguucgugaaguacuggcaggccaagcacaucggcgccgacaucaaggugaaggggcugagcgacccguccaaguucaacagcacgaugagcaccuacaucgacuucaagaagaucuucggcgaccagcugaacgacgugaaccgccagaacgacuucgagaagaucaucgaguacuccaccaucuucgaggaccggaagauccucgaggacaagcugcgcgucgacuucgccuggcugagcgaggagcagaucaagcagcucugccggcugcgccugcagggguggggccggcucuccgacaagcugcugacccgccucacggacgcggacgggcagaacgugcuggagcgccuguggaacagcaacgacaacuucgugcagaucgucuccgaccccaacaucaaggccaagaucgagcaggagaaccagaagcuccugcgggacagccaguccgacaacgccguggagagcauccuggacgacgccuacaccagcccccagaacaagaaggccauccgccaggugaugcgggucgugcacgacaucgugaaggcgugcgacggcaacguccccgccaaguucgccaucgaguucgcccgcagccaggaggacgacccgaagcggaccaccgcgcgcgugaaccagaugcagaagaucuacgaccagaucuccgacgagguggucagccagggcgugaaggagcagcucuccgggaugaagucccugaaggaccgguacuaccuguacuucaugcagggcgggcgcgacgccuacacgggcgccaagcucaacaucgaccggcuguccgacuacgacguggaccacaucaugccccagagcuucgucaaggacgacucccuggacaaccgcgugcucguggcccgggccgucaacaaccagaaguccgacaaggugcccgcgcugcuguucgggaacaagguggucgccgaccucggcaucaccgugcgcgagaugugggacaaguggcagaagcugggcaugaucagcaagcggaagcugagcaaccuccugaccgacagcgacgcccugaccgaguaccgcgcccagggguucauccggcgccagcucguggagaccucccaggucaucaagcugacggccaccauccugcagagcgaguuccccgacuccaagaucaucgaggugccggcgaaguacaacagcaucgugcggaagcaguucgaccucuacaagucccgcgaggucaacgacuuccaccacgccaucgacgccuaccugagcaccaucgugggcaacuaccuguaccagguguaccccaaccuccggcgcauguucgucuacggggaguucaagaaguucuccagcaacgccgaggaguccgcccacgacguggcgcggcgcgucaagagcaugaacuuccuggacgaccugcuccgcggcacccacggcgacaacaucuacugccgguccacgggggagaucguguucaaccgcaacgacaucaucagcaagcugaagcaggccuacuccuucaagcagaugcuggugacccaggagguguucaccaagaaguccgcccucuucaaccagaccgucuaccccagcccgaagcgggacggcagcaagcgcuccgggcugaucccccggaagcgcggcauggaccccgagaucuacgggggcuacgcccacaaccaggacagcuacuucgugcuggcgaagaucgagaaggugaagggcuacacgcuccagaucgucggggugcccauccggagccuggagaucaucaacaaggccgaggacuucuccaccgcccugcucgacaucaucaagagcaaggugauguacaacgagaagaccggccagccgaagcgcgggaucaagaacgucgagauccuggugaacaagcugcccuaccggcagcccauccucgagaaggacgucuccuacaugcugggcagcuccgccuacaaguacaacaucaagcagaucacccugagccgccaguccaugaaguacauccucgacuacaucgacgaccccaacuucacgaagcacgagaugaccaugaucgacgagcagaacgagcgggagugccugcugagcguguacgacgagauccucgagaagguggacaaguaccugccgcuguucgacgggaacaaguuccgcgagaagcuccacuccgcccggaaggaguucgucagccuguccguggacgacgaggcgagcgccaucgagaagauccugcgcggccuccacgccaacuccgagaugcccagccuggagaaccugaagaucaagcccgcccucggcuucuuccagaugaagaacgggaucacccuguccaacgacgccgugcugcucuaccagagccccaccggccuguucgagcggcgcgucaagguguccgaccugcucaaguga

SEQ ID NO: 2196 - RNA, 4308 nt, Artificial Sequence
  Cas9 variant
augaagaacauccugggccucgaccuggggaccaccagcaucggcuucgcccacaucguggaggacgagaacaaggagaaguccgagaucaaggagcuggggguccgcaucgugccccucacgaccgacgagcagagcgacuucgagaagggcaaguccaucaccaccaacgccaaccggacgcugaagcacggggcgcgccugaaccucgaccgguaccagcagcgccggaaguaccugaucgaccugcuccagaaggccaaccugaucaccagcuccagcauccuggccgagaacggcaagaacaccacccacuccacguggcagcuccgcgccaaggccgugaccgagcggaucgagaaggaggaguucgcgcgcguccugcuggccaucaacaagaagcggggcuacaagagcucccgcaaggccaagaccgaggacgaggggcaggccaucgacggcauggcgaucgccaagcggcucuacgacgagaaccugaccacggggcagcugagccuccagcugcugcagcagaacaagaagcuccugccggacuucuaccgcuccgaccugcagaaggaguucgaccucguguggaacuuccagaagcaguucuaccccgacauccugaccgacagcuucuacaaggagcugcagggcaaggggaaggacgccaccuccaaggccuucagcaagcgguaccacuucgacaccgccgagaacaagggcuccaaggagagcgugcgccuccaggcguaccaguggcgggucgaggccaucuccaagcagcugagcaaggaggagguggccuacgugcugacggagaucaacaacaaccucaacaacgccuccggcuaccugggggccaucagcgaccgcagcaaggagcuguacuucaaccggcagaccgucggccaguaccucuacgcgcagcugcaggagaaccgccacaacucccugaagaacaagguguucuaccggcaggacuaccucgacgaguucgagcgcaucugggagacccaggccagcuuccacaaggagcugaccgaggagcugaagaagcagauccgggacguggucaucuucuaccagcgcaagcccaagucccagaaggggcucaucagcuucugcgaguucgaguccaaggagaucgagaucgagaaggacggcaagacgaucaccaagaccaucggcgcccgcguggugcccaagagcuccccgcuguuccaggaguucaagaucuggcagauccugaacaacgucaucugcaagcggaaggggauccgcaagaagaaggugagcgccaagaccacgcagcucgaccugcugaacgaguccagccagaccaucuucucccucgacauggagugcaagcagcugcuguucgaggagcucaaccugaagggcgaccugaaguccgacaaggugcugaagcuccugggguacagcccccaggagugggagaucaacuacaaccagcuggagggcaaccggacccagaaggcccucuacgaggcguaccugaagaucgucgagauggaggcccacgacgugaaggacauccugcagaucaagagcgccaaggacgacuggucccucgacgagagcccccuguccgccagcgagauccgcgaguccgugaaggccaucuuccaggcgcuggggaucugcaccaagauccucuacuucgacccccugcugccggucaaggaguucgagaagcaggacagcuaccagcucuggcaccuccuguacagcuacgaguccgacgacagcacguccggcaacgagacccucuaccggauccuggagaagaaguacgccuucaagcgcgagcacgugcggauccuggccaacguggcccuccaggacgacuacggcagccuguccaccaaggcgauccgcaagaucuaccccaacaucaaggagaaccaguacagcaucgccugcgagauggccggguacaagcacuccaagcugagccucaccacggaggagcuggaggcccgggagcugaagaacaucaucccccuccugaagaagaacgcccugcgcaaccccgucguggagaagauccucaaccagaugaucaacgucgugaacgcgcugaucgagaagaacuccgagcgggacgccgagggcaagaucaccaaguacuuccacuucgacgagauccgcaucgagcuggcccgggagcucaagaagaacgcccagaagcgcuacgagaugacccagaacaucaacaaggccaagcuggagcaccagaagaucagcgagauccugcagaagcaguucgggaucaagaacccgaccaaguccgacaucauccgguaccgccucuaccaggagcuggagcacaacggcuacaaggagcuguacacgaacgcguacaucgcccccgacgugcuguucagcaagaacaucgacaucgagcacaucguccccaaggcccggguguucgacgacuccuucagcaacaagacccuggccuuccgcgaguucaacaucaagaagggggaguccaccgccuucgacuacaucaccagccugaacuccgaggaggagcucaaccaguaccugacccggguggagaacgcguacaagaccaagagcaucagccccaccaaguacaagaaccugcucaagaaggccuccgagaucggcgacgacuucaucaaccgcgaccugcgcgacacccaguacaucgccaagaaggccaaggagauccuguuccaggucaccaagaacgugcucagcacguccggcagcaucaccgaccggcugcgcgaggacugggggcugguggacgucaugaaggagcucaacaugccgaaguaccagucccugggccugaccgagguggaggagcggaaggacgggaacaaggugaccgucaucaagaacuggacgaagcgcaacgaccaccggcaccacgcgauggacgcccucaccguggccuucaccaagcccagcuacauccaguaccugaaccaccugaacgcccgcaaggacgagaacaacaagaacuacuccgugauccucgccaucgaggagaaggagaccaucaagguccggacgaacaacggcaagaacaagcgcguguucaucgagcccauccccaacuuccgccagguggcgaagaagcaccuggaggagaucuucaucagccacaagaccaagaacaaggucgugaccaagaacgugaacaagccggccgggaccgacaagcagcagaucacgcugacgccccggggccagcuccacaaggagaccaucuacggcaaguaccaguacuacgucaacaaggaggagaagaucggggugaaguucgacaaggagaccaucgccaagguguccaacccccuguaccgggaggcccugcucaagcgccugcaggccaacgacaacgaccccaagaaggcguucacgggcaagaacgcccugagcaagaagccgaucuaccucgacgaguccaagaccaagacccugcccgagaaggucaaccugaccuaccucgaggaggacuucagcauccggaaggacaucucccccgacaacuucaaggaccucaagagcaucgagaaggugaucgaccagggggugaagcgcauccugaucaagcggcugcaggccuacgacaacgaccccaagaaggccuucgucgaccuggagaagaacccgaucuggcugaacaaggagaagggcaucgccaucaagcgcgugacgaucuccggcgugaacaacgcgcagccccuccacaucgggaaggaccaccugggcaagaccacccugaacaaggaggggaaggagauccccgucgacuacgugagcaccggcaacaaccaccacguggccaucuaccgggacaaggaggggaaccuccaggagcagaucgucuccuucuucgacgccguggugcgcgcccagcagggccugccgaucaucgacaagacguacaagcaggcggagggcuggcaguucauguucaccaugaagcagaacgagauguucgucuuccccaacgagaccaccggguucaaccccgccgagaucgaccugcucgaccccaagaacaagaagcugaucagcccgaaccuguuccgggugcagacgaucuccguggucaaguacggcaacagcguggugcgcgacuucaaguuccggcaccaccucgagaccacccugcaggacgacaagauccugcaggggaucaccuuccagcagaucaagagccucgagccccugcgcaacaucgucaaggugcgcaucaaccaccugggcgacaucguguccaucggggaguacuga

SEQ ID NO: 2197 - RNA, 4308 nt, Artificial Sequence
  Cas9 variant
augaagaacauccugggccucgaccuggggaccaccagcaucggcuucgcccacaucguggaggacgagaacaaggagaaguccgagaucaaggagcuggggguccgcaucgugagccucgccacggacgagcaguccgacuucgagaagggcaagagcaucuccaccaacgcgaaccggacccugaagcacggggcccgccugaaccucgaccgguaccagcagcgccggaaguuccugaucgaccugcuccagaaggccaaccugaucaccagcgccuccauccuggccgagaacggcaagaacacgacccacagcaccuggcagcuccgcgcgaaggccgugaccgagcggaucgagaaggaggaguucgcccgcguccugcuggccaucaacaagaagcggggcuacaagaacucccgcaagacgaagaccgaggacgaggggcaggcgaucgacggcauggccaucgccaagugccucuacgacgagaaccugacccccgggcagcugagccuccagcugcugcagcagaacaagaagcuccugccggacuucuaccgguccgaccugcagaaggaguucgaccucguguggaaccugcagaagcaguucuaccccgacauccugaccgacagcuucuacaaggagcuccagggcaaggggaaggacgccacguccaaggccuucagcaagcgcuaccacuucgacaccgcggagaacaagggcuccaaggagagcgugcggcugcaggccuaccaguggcgcgccgaggccaucuccaagcagcugagcaaggaggaggucgccuacgugcucaccgagaucaacaacaaccugaacaacuccagcggcuaccugggggcgaucagcgaccgguccaaggagcucuacuucaaccgccagaccgugggccaguaccuguacgcccagcugcaggagaaccggcacaacagccucaagaacaaggucuucuaccgccaggacuaccuggacgaguucgagcggaucugggagacgcaggccuccuuccacaaggagcugaccgacgagcucaagaagcagauccgcgacguggugaucuucuaccagcggaagcucaagagccagaaggggcuggucuccuucugcgaguucgagagcaaggagaucgagaucgagaaggacggcaaggccaucaccaaguccaucggcgcccgcguggugcccaagagcagcccccucuuccaggaguucaagaucuggcagauccugaacaacgucacgugcaagcgcaaggggauccggaagaagaaguccuccgccaagagcacggagcuggaccucuucaacgagccgucccagagcaucuucucccuggacauggagugcaagcagcugcuguucgacgagcugaaccugaagggcgaccucaagagcgacaaggugcugaagcugcugggguacagcccccaggagugggagaucaacuacaaccagcucgagggcaaccgcacccagaagucccuguacgaggcguaccugaagaucaucgagaucgagggguacgaggugaaggacauccuccagaucaaguccaccaaggacgacuggagccuggacgagagcccccuguccgccagcgagauccgggagcgcgucaaggugaucuuccagacccucggcaucugcacgaagauccuguacuucgacccccugcucccggugaaggaguucgagcagcaguacuccuaccagcuguggcaccuccuguacagcuacgaguccgacgacagcaccuccggcaacgagacccuguaccggauccuggagaagaaguacgccuucaagcgcgagcacgccaccauccucgcgaacgucgcccugcaggacgacuacgggagccuguccacgaaggccauccggaagaucuaccccuacaucaaggagaaccaguacagcaccgccugcgagcucgcgggcuacaagcacuccaagcugagccugaccaccgaggagcucgaggcccgcgagcugaagaacaucaucccccugcucaagaagaacgcccugcggaaccccgugguggagaagauccugaaccagaugaucaacgucgugaacgcccucaucgagaagaacuccgagcgcgacgccgaggggaagaucacgaaguacuuccacuucgacgagauccggaucgagcuggcgcgcgagcugaagaagaacgcccaggagcgguacgagaugacccagaacaucaacaaggccaagcucgagcaccagaagaucagcgagaagcugcagaagcaguucggcaucaagaacccgaccaaguccgacaucauccgcuaccggcuguaccaggagcucgagcacaacggguacaaggagcuguacaccaacacguacaucgcccccgacguccuguucagcaagaacaucgacaucgagcacaucgugcccaaggcccgcguguucgacgacuccuucagcaacaagacccucgcguucaaggaguucaacaucaagaagggcgagagcaccgccuucgacuacaucaccucccugaacugcgagggcgagcugaaccaguaccucacccgggucgagaacgccuacaagaccaagagcaucucccugaccaaguacaagaaccugcucaagaaggccagcgagaucggggacggcuucaucaaccgcgaccugcgggacacccaguacaucgccaagaaggcgaaggagauccuguuccaggugaccaagaacgugcucuccacgagcggguccaucaccgaccgccugcgcgaggacuggggccuggucgacgugaugaaggagcucaacaugcccaaguaccagagccuggggcugaccgagguggaggagcggaaggacggcaacaaggucaccgugaucaaggacuggacgaagcgcaacgaccaccggcaccacgccauggacgcccucaccguggccuucaccaagccguccuacauccaguaccugaaccaccugaacgcgcgcaaggacgagaacaacaagaacuacagcgucauccucgccaucgagaagaaggagaccaucaaggugcccaucaacaacggcaagaacaagcggguguucaucgagcccauccugaacuuccgccaggucgccaagaagcaccuggaggagaucuucaucucccacaaggccaagaacaagguggugacgaagaacaucaacaagcccgccgggaccgacaagcagcagaucacccucaccccgcggggccagcugcacaaggagacgaucuacgggaaguaccaguacuacgucaacaaggaggagaaggugggcgugaaguucgacgagcgcaccaucaccaaggucagcaacccccuguaccgggaggcgcuccugaagcgccugcaggccaacgacaacgaccccaagaaggccuucgccggcaagaacgcccucuccaagaaccccaucuaccuggacgaggcgaagaccaagacgcugccggagaaggugaaccucaccuaccuggaggaggacuucagcauccggaaggacaucucccccgacaacuucaaggaccucaagagcaucgagaaggugaucgaccagggggucaagcgcauccugaucaagcggcugcaggccuacgacaacgaccccaagaaggccuucguggaccuggagaagaaccccaucuggcucaacaaggagaagggcaucgccaucaagcgcgugaccaucuccggggucagcaacgcccagccgcugcacaucggcaaggaccaccuggggaagaccacgcucaacaaggagggcaaggaggugcccguggacuacgucuccaccggcaacaaccaccacguggcgaucuaccgggacaaggaggggaaccugcaggagcagaucgugagcuucuucgaggccgucgugcgcgcccagcagggccugcccaucaucgacaagaacuacaagcaggccgagggguggcaguucauguucaccaugaagcagaacgagauguucguguucccgaacgaggcgaccggcuucaaccccgccgagaucgaccuccuggaccccaagaacaagaagcugaucagccccaaccucuuccggguccagacgaucuccaucgugaaguacgggaacagcgugguccgcgacuucaaguuccggcaccaccuggagaccacccugcaggacgacaagauccuccagggcaucaccuuccagcagaucaagucccuggagccgcugcgcaacaucgugaaggugcggaucaaccaccucggcgacaucgucaacaucggggaguacuga

SEQ ID NO: 2198 - RNA, 4311 nt, Artificial Sequence
  Cas9 variant
augaagcgcauccugggccucgaccuggggaccaacagcaucggcugggcccuggugaacgaggccgagaacaaggacgagcgguccagcaucgucaagcucggggugcgcgugaacccccugaccgucgacgagcugacgaacuucgagaagggcaaguccaucaccaccaacgcggaccggacccucaagcgcgggaugcggcgcaaccugcagcgguacaagcugcgccgggagacgcucaccgaggugcugaaggagcacaagcugaucaccgaggacaccauccucagcgagaacggcaaccgcacgaccuucgagaccuaccggcugcgcgccaaggccgugaccgaggagaucucccuggaggaguucgcccggguccuccugaugaucaacaagaagcgcggcuacaagagcucccggaaggccaaggggguggaggagggcacgcugaucgacgggauggacaucgcgcgcgagcucuacaacaacaaccugaccccgggcgagcugugccuccagcugcuggacgccgggaagaaguuccuccccgacuucuaccggagcgaccugcagaacgagcuggaccgcaucugggagaagcagaaggaguacuaccccgagauccucaccgacgugcugaaggaggagcugcggggcaagaagcgcgacgccgucugggccaucugcgcgaaguacuucguguggaaggagaacuacaccgaguggaacaaggagaagggcaagacggagcagcaggagcgggagcacaagcucgaggggaucuacuccaagcgcaagcgcgacgaggccaagcgggagaaccugcaguggcgcgugaacggccugaaggagaagcucagccuggagcagcuggucaucguguuccaggagaugaacacccagaucaacaacuccagcggguaccucggcgccaucuccgaccggagcaaggagcuguacuucaacaagcagaccgugggccaguaccagauggagaugcuggacaagaaccccaacgccucccuccgcaacauggucuucuaccggcaggacuaccuggacgaguucaacaugcugugggagaagcaggccguguaccacaaggagcucaccgaggagcugaagaaggagauccgcgacaucaucaucuucuaccagcggcgccucaagagccagaaggggcugaucggcuucugcgaguucgagucccggcagaucgagguggacaucgacgggaagaagaagaucaagacggucggcaaccgcgugaucagccgguccagcccgcuguuccaggaguucaagaucuggcagauccugaacaacaucgaggugaccgucguggggaagaagcgcaagcggcgcaagcucaaggagaacuacagcgcgcuguucgaggagcugaacgacgccgagcagcuggagcucaacggcucccggcgccugugccaggaggagaaggagcugcucgcccaggagcuguucgugcgggacaagaugaccaagagcgagguccugaagcuccuguucgacaacccccaggagcuggaccucaacuucaagaccaucgacggcaacaagacgggguacgcccuguuccaggccuacuccaagaugaucgagaugagcggccacgagcccguggacuucaagaagcccgucgagaaggugguggaguacaucaaggcggucuucgaccugcucaacuggaacaccgacauccugggguucaacuccaacgaggagcuggacaaccagagcuacuacaagcucuggcaccuccuguacuccuucgagggcgacaacaccccgaccgggaacggccgccugauccagaagaugacggagcuguacggcuucgagaaggaguacgccaccauccuggccaacgugagcuuccaggacgacuacgggucccucagcgccaaggccauccacaagauccugccccaccugaaggagggcaaccgguacgacguggcgugcgucuacgccggguaccgccacuccgagagcucccucacccgcgaggagaucgccaacaaggugcugaaggaccggcugaugcuccugcccaagaacagccugcacaaccccguggucgagaagauccucaaccagauggugaacgugaucaacgucaucaucgacaucuacggcaagccggacgagauccgcguggagcuggcccgggagcugaagaagaacgccaaggagcgcgaggagcucaccaaguccaucgcgcagacgaccaaggcccacgaggaguacaagacccugcugcagaccgaguucgggcucacgaacgugagccggaccgacauccugcgcuacaagcuguacaaggagcucgaguccugcggcuacaagacccuguacagcaacaccuacaucucccgggagaagcuguucagcaaggaguucgacaucgagcacaucaucccccaggcccgccucuucgacgacagcuucuccaacaagacccuggaggcccggagcgucaacaucgagaagggcaacaacacggcguacgacuucgugaaggagaaguucggggaguccggcgccgacaacagccuggagcaguaccucaacaacaucgaggaccuguucaaguccgggaagaucagcaagaccaaguacaacaagcugaagauggccgagcaggacauccccgacggcuucaucgagcgcgaccuccggaacacccaguacaucgccaagaaggcccuguccaugcugaacgagaucagccaccgcguggucgcgaccuccggcagcgugacggacaagcuccgggaggacuggcagcugaucgacgugaugaaggagcugaacugggagaaguacaaggcccucgggcuggucgaguacuucgaggaccgcgacggccggcagaucgggcgcaucaaggacuggaccaagcggaacgaccaccgccaccacgccauggacgcccugaccguggccuucaccaaggacguguucauccaguacuucaacaacaagaacgcgucccucgaccccaacgccaacgagcacgccaucaagaacaaguacuuccagaacggccgggccaucgccccgaugccccugcgcgaguuccgggcggaggccaagaagcaccuggagaacacgcucaucagcaucaaggccaagaacaaggucaucaccgggaacaucaacaagacccgcaagaagggcggcgugaacaagaacaugcagcagacgccccgcgggcagcugcaccuggagaccaucuacggcuccgggaagcaguaccucaccaaggaggagaaggugaacgccagcuucgacaugcggaagaucggcaccgucuccaagagcgcguaccgcgacgcccugcugaagcggcucuacgagaacgacaacgaccccaagaaggccuucgccgggaagaacucccuggacaagcagccgaucuggcuggacaaggagcagaugcgcaaggugcccgagaaggugaagaucgucacccucgaggccaucuacacgauccggaaggagaucagccccgaccugaagguggacaaggugaucgacgucggcgugcgcaagauccugaucgaccggcucaacgaguacggcaacgacgcgaagaaggccuucagcaaccuggacgagaaccccaucuggcugaacaaggagaaggggaucuccaucaagcgcgugaccaucagcggcaucuccaacgcccagagccuccacgucaagaaggacaaggacgggaagccgauccuggacgagaacggccggaacauccccguggacuucgugaacaccgggaacaaccaccacgucgccguguacuaccgccccgugaucgacaagcggggccagcuggucguggacgaggccggcaaccccaaguacgagcucgaggagguggucguguccuucuucgaggcggugacccgcgccaaccuggggcagccgaucaucgacaaggacuacaagacgaccgagggcuggcaguuccuguucagcaugaagcagaacgaguacuucgucuuccccaacgagaagaccggguucaaccccaaggagaucgaccuccuggacguggagaacuacggccugaucuccccgaaccucuuccgggugcagaaguucagccugaagaacuacgucuuccgccaccaccuggagaccacgaucaaggacaccuccagcauccuccgggggaucaccuggaucgacuuccgcuccagcaagggccuggacaccaucgugaagguccgggugaaccacaucggccagaucguguccgucggggaguacuga

SEQ ID NO: 2199 - RNA, 4311 nt, Artificial Sequence
  Cas9 variant
augaagcgcauccugggccucgaccuggggaccaacagcaucggcugggcccuggugaacgaggccgagaacaaggacgagcgguccagcaucgucaagcucggggugcgcgugaacccccugaccgucgacgagcugacgaacuucgagaagggcaaguccaucaccaccaacgcggaccggacccucaagcgcgggaugcggcgcaaccugcagcgguacaagcugcgccgggagacgcucaccgaggugcugaaggagcacaagcugaucaccgaggacaccauccucagcgagaacggcaaccgcacgaccuucgagaccuaccggcugcgcgccaaggccgugaccgaggagaucucccuggaggaguucgcccggguccuccugaugaucaacaagaagcgcggcuacaagagcucccggaaggccaaggggguggaggagggcacgcugaucgacgggauggacaucgcgcgcgagcucuacaacaacaaccugaccccgggcgagcugugccuccagcugcuggacgccgggaagaaguuccuccccgacuucuaccggagcgaccugcagaacgagcuggaccgcaucugggagaagcagaaggaguacuaccccgagauccucaccgacgugcugaaggaggagcugcggggcaagaagcgcgacgccgucugggccaucugcgcgaaguacuucguguggaaggagaacuacaccgaguggaacaaggagaagggcaagacggagcagcaggagcgggagcacaagcucgaggggaucuacuccaagcgcaagcgcgacgaggccaagcgggagaaccugcaguggcgcgugaacggccugaaggagaagcucagccuggagcagcuggucaucguguuccaggagaugaacacccagaucaacaacuccagcggguaccucggcgccaucuccgaccggagcaaggagcuguacuucaacaagcagaccgugggccaguaccagauggagaugcuggacaagaaccccaacgccucccuccgcaacauggucuucuaccggcaggacuaccuggacgaguucaacaugcugugggagaagcaggccguguaccacaaggagcucaccgaggagcugaagaaggagauccgcgacaucaucaucuucuaccagcggcgccucaagagccagaaggggcugaucggcuucugcgaguucgagucccggcagaucgagguggacaucgacgggaagaagaagaucaagacggucggcaaccgcgugaucagccgguccagcccgcuguuccaggaguucaagaucuggcagauccugaacaacaucgaggugaccgucguggggaagaagcgcaagcggcgcaagcucaaggagaacuacagcgcgcuguucgaggagcugaacgacgccgagcagcuggagcucaacggcucccggcgccugugccaggaggagaaggagcugcucgcccaggagcuguucauccgggacaagaugaccaagagcgaggugcugaagcuccuguucgacaacccccaggagcuggaccucaacuucaagaccaucgacggcaacaagacgggguacgcccuguuccaggccuacuccaagaugaucgagaugagcggccacgagcccgucgacuucaagaagcccguggagaaggucguggaguacaucaaggcgguguucgaccugcucaacuggaacaccgacauccugggguucaacuccaacgaggagcuggacaaccagccguacuacaagcucuggcaccuccuguacagcuucgagggcgacaacacccccaccgggaacggccgccugauccagaagaugacggagcuguacggcuucgagaaggaguacgccaccauccuggccaacgucuccuuccaggacgacuacgggagccucuccgccaaggccauccacaagauccugccccaccugaaggagggcaaccgguacgacguggcgugcguguacgccggguaccgccacagcgaguccagccucacccgcgaggagaucgccaacaagguccugaaggaccggcugaugcuccugcccaagaacucccugcacaacccggugguggagaagauccucaaccagauggucaacgugaucaacgugaucaucgacaucuacggcaagcccgacgagauccgcgucgagcuggcccgggagcugaagaagaacgccaaggagcgcgaggagcucaccaagagcaucgcgcagacgaccaaggcccacgaggaguacaagacccugcugcagaccgaguucgggcucacgaacgugucccggaccgacauccugcgcuacaagcuguacaaggagcucgagagcugcggcuacaagacccuguacuccaacaccuacaucagccgggagaagcuguucuccaaggaguucgacaucgagcacaucaucccccaggcccgccucuucgacgacagcuucagcaacaagacccuggaggcccgguccgugaacaucgagaagggcaacaagacggcguacgacuucgucaaggagaaguucggggagagcggcgccgacaacucccuggagcacuaccucaacaacaucgaggaccuguucaagagcgggaagaucuccaagaccaaguacaacaagcugaagauggccgagcaggacauccccgacggcuucaucgagcgcgaccuccggaacacccaguacaucgccaagaaggcccugagcaugcugaacgagaucucccaccgcgugguggcgaccagcggcuccgucacggacaagcuccgggaggacuggcagcugaucgacgugaugaaggagcugaacugggagaaguacaaggcccucgggcugguggaguacuucgaggaccgcgacggccggcagaucgggcgcaucaaggacuggaccaagcggaacgaccaccgccaccacgccauggacgcccugaccgucgccuucaccaaggacguguucauccaguacuucaacaacaagaacgcgagccucgacccgaacgccaacgagcacgccaucaagaacaaguacuuccagaacggccgggccaucgcccccaugccccugcgcgaguuccgggcggaggccaagaagcaccuggagaacacgcucaucuccaucaaggccaagaacaaggugaucaccgggaacaucaacaagacccgcaagaagggcggcgucaacaagaacaugcagcagacgccccgcgggcagcugcaccuggagaccaucuacggcagcgggaagcaguaccucaccaaggaggagaaggugaacgccuccuucgacaugcggaagaucggcaccgugagcaaguccgcguaccgcgacgcccugcugaagcggcucuacgagaacgacaacgacccgaagaaggccuucgccgggaagaacagccuggacaagcagcccaucuggcuggacaaggagcagaugcgcaagguccccgagaaggugaagaucgugacccucgaggccaucuacacgauccggaaggagaucucccccgaccugaaggucgacaaggugaucgacgugggcguccgcaagauccugaucgaccggcucaacgaguacggcaacgacgcgaagaaggccuucagcaaccuggacaagaacccgaucuggcugaacaaggagaaggggaucagcaucaagcgcgugaccaucuccggcaucagcaacgcccagucccuccacgugaagaaggacaaggacgggaagcccauccuggacgagaacggccggaacauccccgucgacuucgugaacaccgggaacaaccaccacguggccgucuacuaccgccccgugaucgacaagcggggccagcugguggucgacgaggccggcaacccgaaguacgagcucgaggaggugguggucagcuucuucgaggcggugacccgcgccaaccuggggcugcccaucaucgacaaggacuacaagacgaccgagggcuggcaguuccucuucuccaugaagcagaacgaguacuucguguuccccaacgagaagaccggguucaacccgaaggagaucgaccugcuggacgucgagaacuacggccucaucagccccaaccuguuccgggugcagaaguucucccugaagaacuacguguuccgccaccaccucgagaccacgaucaaggacaccagcuccauccugcgggggaucaccuggaucgacuuccgcagcuccaagggccuggacaccaucgucaaggugcgggucaaccacaucggccagaucgugagcgugggggaguacuga

SEQ ID NO: 2200 - RNA, 4311 nt, Artificial Sequence
  Cas9 variant
augaagcgcauccugggccucgaccuggggaccaacagcaucggcugggcccuggugaacgaggccgagaacaaggacgagcgguccagcaucgucaagcucggggugcgcgugaacccccugaccgucgacgagcugacgaacuucgagaagggcaaguccaucaccaccaacgcggaccggacccucaagcgcgggaugcggcgcaaccugcagcgguacaagcugcgccgggagacgcucaccgaggugcugaaggagcacaagcugaucaccgaggacaccauccucagcgagaacggcaaccgcacgaccuucgagaccuaccggcugcgcgccaaggccgugaccgaggagaucucccuggaggaguucgcccggguccuccugaugaucaacaagaagcgcggcuacaagagcucccggaaggccaaggggguggaggagggcacgcugaucgacgggauggacaucgcgcgcgagcucuacaacaacaaccugaccccgggcgagcugugccuccagcugcuggacgccgggaagaaguuccuccccgacuucuaccggagcgaccugcagaacgagcuggaccgcaucugggagaagcagaaggaguacuaccccgagauccucaccgacgugcugaaggaggagcugcggggcaagaagcgcgacgccgucugggccaucugcgcgaaguacuucguguggaaggagaacuacaccgaguggaacaaggagaagggcaagacggagcagcaggagcgggagcacaagcucgaggggaucuacuccaagcgcaagcgcgacgaggccaagcgggagaaccugcaguggcgcgugaacggccugaaggagaagcucagccuggagcagcuggucaucguguuccaggagaugaacacccagaucaacaacuccagcggguaccucggcgccaucuccgaccggagcaaggagcuguacuucaacaagcagaccgugggccaguaccagauggagaugcuggacaagaaccccaacgccucccuccgcaacauggucuucuaccggcaggacuaccuggacgaguucaacaugcugugggagaagcaggccguguaccacaaggagcucaccgaggagcugaagaaggagauccgcgacaucaucaucuucuaccagcggcgccucaagagccagaaggggcugaucggcuucugcgaguucgagucccggcagaucgagguggacaucgacgggaagaagaagaucaagacggucggcaaccgcgugaucagccgguccagcccgcuguuccaggaguucaagaucuggcagauccugaacaacaucgaggugaccgucguggggaagaagcgcaagcggcgcaagcucaaggagaacuacagcgcgcuguucgaggagcugaacgacgccgagcagcuggagcucaacggcucccggcgccugugccaggaggagaaggagcugcucgcccaggagcuguucauccgggacaagaugaccaagagcgaggugcugaagcuccuguucgacaacccccaggagcuggaccucaacuucaagaccaucgacggcaacaagacgggguacgcccuguuccaggccuacuccaagaugaucgagaugagcggccacgagcccgucgacuucaagaagcccguggagaaggucguggaguacaucaaggcgguguucgaccugcucaacuggaacaccgacauccugggguucaacuccaacgaggagcuggacaaccagagcuacuacaagcucuggcaccuccuguacuccuucgagggcgacaacaccccgaccgggaacggccgccugauccagaagaugacggagcuguacggcuucgagaaggaguacgccaccauccuggccaacgucagcuuccaggacgacuacgggucccucagcgccaaggccauccacaagauccugccccaccugaaggagggcaaccgguacgacguggcgugcguguacgccggguaccgccacuccgagagcucccucacccgcgaggagaucgccaacaagguccugaaggaccggcugaugcuccugcccaagaacagccugcacaaccccgugguggagaagauccucaaccagauggucaacgugaucaacgugaucaucgacaucuacggcaagccggacgagauccgcgucgagcuggcccgggagcugaagaagaacgccaaggagcgcgaggagcucaccaaguccaucgcgcagacgaccaaggcccacgaggaguacaagacccugcugcagaccgaguucgggcucacgaacgugagccggaccgacauccugcgcuacaagcuguacaaggagcucgaguccugcggcuacaagacccuguacagcaacaccuacaucucccgggagaagcuguucagcaaggaguucgacaucgagcacaucaucccccaggcccgccucuucgacgacagcuucuccaacaagacccuggaggcccggagcgugaacaucgagaagggcaacaagacggcguacgacuucgucaaggagaaguucggggaguccggcgccgacaacagccuggagcacuaccucaacaacaucgaggaccuguucaaguccgggaagaucagcaagaccaaguacaacaagcugaagauggccgagcaggacauccccgacggcuucaucgagcgcgaccuccggaacacccaguacaucgccaagaaggcccuguccaugcugaacgagaucagccaccgcgugguggcgaccuccggcagcgucacggacaagcuccgggaggacuggcagcugaucgacgugaugaaggagcugaacugggagaaguacaaggcccucgggcugguggaguacuucgaggaccgcgacggccggcagaucgggcgcaucaaggacuggaccaagcggaacgaccaccgccaccacgccauggacgcccugaccgucgccuucaccaaggacguguucauccaguacuucaacaacaagaacgcgucccucgaccccaacgccaacgagcacgccaucaagaacaaguacuuccagaacggccgggccaucgccccgaugccccugcgcgaguuccgggcggaggccaagaagcaccuggagaacacgcucaucagcaucaaggccaagaacaaggugaucaccgggaacaucaacaagacccgcaagaagggcggcgucaacaagaacaugcagcagacgccccgcgggcagcugcaccuggagaccaucuacggcuccgggaagcaguaccucaccaaggaggagaaggugaacgccagcuucgacaugcggaagaucggcaccguguccaagcuggcguaccgcgacgcccugcucaagcggcuguacgagaacgacaacgaccccaagaaggccuucgccgggaagaacagccuggacaagcagccgaucuggcucgacaaggagcagaugcgcaagguccccgagaaggugaagaucgugacccuggaggccaucuacacgauccggaaggagaucucccccgaccugaaggucgacaaggugaucgacgugggcguccgcaagauccucaucgaccggcugaacgaguacggcaacgacgcgaagaaggccuucagcaaccuggacgagaaccccaucuggcucaacaaggagaaggggaucagcaucaagcgcgugaccaucuccggcaucagcaacgcccagucccugcacgugaagaaggacaaggacgggaagccgauccuggacgagaacggccggaacauccccgucgacuucgugaacaccgggaacaaccaccacguggccgucuacuaccgccccgugaucgacaagcggggccagcucguggucgacgaggccggcaaccccaaguacgagcuggaggaggugguggucagcuucuucgaggcggugacccgcgccaaccuggggcagccgaucaucgacaaggacuacaagacgaccgagggcuggcaguuccucuucuccaugaagcagaacgaguacuucguguuccccaacgagaagaccggguucaaccccaaggagaucgaccugcuggacgucgagaacuacggccucaucagcccgaaccuguuccgggugcagaaguucucccugaagaacuacguguuccgccaccaccucgagaccacgaucaaggacaccagcuccauccugcgggggaucaccuggaucgacuuccgcagcuccaagggccuggacaccaucgucaaggugcgggucaaccacaucggccagaucgugagcgugggggaguacuga

SEQ ID NO: 2201 - RNA, 4311 nt, Artificial Sequence
  Cas9 variant
augaagcgcauccugggccucgaccuggggaccaacagcaucggcugggcccuggugaacgaggccgagaacaaggacgagcgguccagcaucgucaagcucggggugcgcgugaacccccugaccgucgacgagcugacgaacuucgagaagggcaaguccaucaccaccaacgcggaccggacccucaagcgcgggaugcggcgcaaccugcagcgguacaagcugcgccgggagacgcucaccgaggugcugaaggagcacaagcugaucaccgaggacaccauccucagcgagaacggcaaccgcacgaccuucgagaccuaccggcugcgcgccaaggccgugaccgaggagaucucccuggaggaguucgcccggguccuccugaugaucaacaagaagcgcggcuacaagagcucccggaaggccaaggggguggaggagggcacgcugaucgacgggauggacaucgcgcgcgagcucuacaacaacaaccugaccccgggcgagcugugccuccagcugcuggacgccgggaagaaguuccuccccgacuucuaccggagcgaccugcagaacgagcuggaccgcaucugggagaagcagaaggaguacuaccccgagauccucaccgacgugcugaaggaggagcugcggggcaagaagcgcgacgccgucugggccaucugcgcgaaguacuucguguggaaggagaccuacacggaguggaacaaggagaagggcaagaccgagcagcaggagcgggagcacaagcucgaggggaucuacuccaagcgcaagcgcgacgaggccaagcgggagaaccugcaguggcgcgugaacggccugaaggagaagcucagccuggagcagcuggucaucguguuccaggagaugaacacccagaucaacaacuccagcggguaccucggcgccaucuccgaccggagcaaggagcuguacuucaacaagcagaccgugggccaguaccagauggagaugcuggacaagaaccccaacgccucccuccgcaacauggucuucuaccggcaggacuaccuggacgaguucaacaugcugugggagaagcaggccguguaccacaaggagcucacggaggagcugaagaaggagauccgcgacaucaucaucuucuaccagcggcgccucaagagccagaaggggcucaucggcuucugcgaguucgagucccggcagaucgagguggacaucgacgggaagaagaagaucaagaccgucggcaaccgcgugaucagccgguccagcccgcuguuccaggaguucaagaucuggcagauccugaacaacaucgaggugaccgucguggggaagaagcgcaagcggcgcaagcucaaggagaacuacagcgcgaucuucgaggagcugaacgacgccgagcagcuggagcugaacggcucccggcgccucugccaggaggagaaggagcugcuggcccaggagcuguucgugcgggacaagaugaccaagagcgagguccugaagcuccuguucgacaacccccaggagcuggaccugaacuucaagacgaucgacggcaacaagaccggguacgcccucuuccaggccuacuccaagaugaucgagaugagcggccacgagcccguggacuucaagaagcccgucgagaaggugguggaguacaucaaggcggucuucgaccugcugaacuggaacaccgacauccucggguucaacuccaacgaggagcuggacaaccagagcuacuacaagcuguggcaccuccuguacuccuucgagggcgacaacaccccgacggggaacggccgccugauccagaagaugaccgagcucuacggcuucgagaaggaguacgccaccauccuggccaacgugagcuuccaggacgacuacgggucccugagcgccaaggccauccacaagauccucccccaccugaaggagggcaaccgguacgacguggcgugcgucuacgccggguaccgccacuccgagagcucccugacccgcgaggagaucgccaacaaggugcucaaggaccggcugaugcugcuccccaagaacagccugcacaaccccguggucgagaagauccugaaccagauggugaacgugaucaacgucaucaucgacaucuacggcaagccggacgagauccgcguggagcucgcccgggagcugaagaagaacgccaaggagcgcgaggagcugacgaaguccaucgcgcagaccaccaaggccaacgaggaguacaagacccuccugcagacggaguucgggcugaccaacgugagccggaccgacauccuccgcuacaagcuguacaaggagcuggaguccugcggcuacaagacccucuacagcaacaccuacaucucccgggagaagcuguucagcaaggaguucgacaucgagcacaucaucccccaggcccgccuguucgacgacagcuucuccaacaagacgcucgaggcccggagcgucaacaucgagaagggcaacaagaccgcguacgacuucgugaaggagaaguucggggaguccggcgccgacaacagccuggagcacuaccugaacaacaucgaggaccucuucaaguccgggaagaucagcaagaccaaguacaacaagcugaagauggccaagcaggacauccccgacggcuucaucgagcgcgaccugcggaacacccaguacaucgccaagaaggcccucuccaugcugaacgagaucagccaccgcguggucgcgacguccggcagcgugaccgacaagcugcgggaggacuggcagcucaucgacgugaugaaggagcugaacugggagaaguacaaggcccuggggcucgucgaguacuucgaggaccgcgacggccggcagaucgggcgcaucaaggacuggaccaagcggaacgaccaccgccaccacgccauggacgcccugaccguggccuucacgaaggacguguucauccaguacuucaacaacaagaacgcgucccuggaccccaacgccaacgagcacgccaucaagaacaaguacuuccagaacggccgggccaucgccccgaugccccuccgcgaguuccgggcggaggccaagaagcaccuggagaacacccugaucagcaucaaggccaagaacaaggucaucaccgggaacaucaacaagacccgcaagaagggcggcgugaacaagaacaugcagcagacgccccgcgggcagcuccaccuggagaccaucuacggcuccgggaagcaguaccugaccaaggaggagcgggugaacgccagcuucgacaugcgcaagaucgagaccgucuccaagagcgcguaccgggacgcccuccugaagcgccuguacgagaacgacaacgaccccaagaaggccuucgccggcaagaacucccucgacaagcagccgaucuggcuggacaaggagcagaagcggaaggugcccgagaaggugaagaucgucacgcuggaggccaucuacaccauccgcaaggagaucagccccgaccucaagguggacaaggugaucgacgucggggugcggaagauccugaucgaccgccugaacgaguacggcaacgacgcgaagaaggccuucagcaaccucgacgagaaccccaucuggcugaacaaggagaagggcaucuccaucaagcgggugaccaucagcgggaucuccaacgcccagagccugcacgucaagaaggacaaggacggcaagccgauccucgacgagaacgggcgcaacauccccguggacuucgugaacaccggcaacaaccaccacgucgccguguacuaccggcccgugaucgacaagcgcgggcagcuggucguggacgaggccggcaaccccaaguacgagcuggaggagguggucguguccuucuucgaggcggugacgcgggccaaccucggccagccgaucaucgacaaggacuacaagaccaccgagggguggcaguuccuguucagcaugaagcagaacgaguacuucgucuuccccaacgagaagaccggcuucaaccccaaggagaucgaccugcucgacguggagaacuacgggcugaucuccccgaaccuguuccgcgugcagaaguucagccucaagaacuacgucuuccggcaccaccuggagacgaccaucaaggacaccuccagcauccugcgcggcaucaccuggaucgacuuccgguccagcaaggggcucgacacgaucgugaagguccgcgugaaccacaucggccagaucguguccgucggcgaguacuga

SEQ ID NO: 2202 - RNA, 4311 nt, Artificial Sequence
  Cas9 variant
augaagcgcauccugggccucgaccuggggaccaacagcaucggcugggcccuggugaacgaggccgagaacaaggacgagcgguccagcaucgucaagcucggggugcgcgugaacccccugaccgucgacgagcugacgaacuucgagaagggcaaguccaucaccaccaacgcggaccggacccucaagcgcgggaugcggcgcaaccugcagcgguacaagcugcgccgggagacgcucaccgaggugcugaaggagcacaagcugaucaccgaggacaccauccucagcgagaacggcaaccgcacgaccuucgagaccuaccggcugcgcgccaaggccgugaccgaggagaucucccuggaggaguucgcccggguccuccugaugaucaacaagaagcgcggcuacaagagcucccggaaggccaaggggguggaggagggcacgcugaucgacgggauggacaucgcgcgcgagcucuacaacaacaaccugaccccgggcgagcugugccuccagcugcuggacgccgggaagaaguuccuccccgacuucuaccggagcgaccugcagaacgagcuggaccgcaucugggagaagcagaaggaguacuaccccgagauccucaccgacgugcugaaggaggagcugcggggcaagaagcgcgacgccgucugggccaucugcgcgaaguacuucguguggaaggagaccuacacggaguggaacaaggagaagggcaagaccgagcagcaggagaaggagcacaagcucgaggggaucuacuccaagcggaagcgcgacgaggccaagcgcgagaaccugcaguggcgggugaacggccugaaggagaagcucagccuggagcagcuggucaucguguuccaggagaugaacacccagaucaacaacuccagcggguaccucggcgccaucuccgaccgcagcaaggagcuguacuucaacaagcagaccgugggccaguaccagauggagaugcuggacaagaaccccaacgccucccuccggaacauggucuucuaccgccaggacuaccuggacgaguucaacaugcugugggagaagcaggccguguaccacaaggagcucacggaggagcugaagaaggagauccgggacaucaucaucuucuaccagcgccggcucaagagccagaaggggcucaucggcuucugcgaguucgagucccgccagaucgagguggacaucgacgggaagaagaagaucaagaccgucggcaaccgggugaucagccgcuccagcccgcuguuccaggaguucaagaucuggcagauccugaacaacaucgaggugaccgucguggggaagaagcggaagcgccggaagcucaaggagaacuacagcgcgcuguucgaggagcugaacgacgccgagcagcuggagcucaacggcucccgccggcugugccaggaggagaaggagcugcucgcccaggagcuguucauccgcgacaagaugaccaagagcgaggugcugaagcuccuguucgacaacccccaggagcuggaccucaacuucaagacgaucgacggcaacaagaccggguacgcccuguuccaggccuacuccaagaugaucgagaugagcggccacgagcccgucgacuucaagaagcccguggagaaggucguggaguacaucaaggcgguguucgaccugcucaacuggaacaccgacauccugggguucaacuccaacgaggagcuggacaaccagagcuacuacaagcucuggcaccuccuguacuccuucgagggcgacaacaccccgacggggaacggccggcugauccagaagaugaccgagcuguacggcuucgagaaggaguacgccaccauccuggccaacgucagcuuccaggacgacuacgggucccucagcgccaaggccauccacaagauccugccccaccugaaggagggcaaccgcuacgacguggcgugcguguacgccggguaccggcacuccgagagcucccucacccgcgaggagaucgccaacaagguccugaaggaccgccugaugcuccugcccaagaacagccugcacaaccccgugguggagaagauccucaaccagauggucaacgugaucaacgugaucaucgacaucuacggcaagccggacgagauccgggucgagcuggcccgcgagcugaagaagaacgccaaggagcgggaggagcucacgaaguccaucgcgcagaccaccaaggcccacgaggaguacaagacccugcugcagacggaguucgggcucaccaacgugagccgcaccgacauccugcgguacaagcuguacaaggagcucgaguccugcggcuacaagacccuguacagcaacaccuacaucucccgcgagaagcuguucagcaaggaguucgacaucgagcacaucaucccccaggcccggcuguucgacgacagcuucuccaacaagacgcuggaggcccgcagcgugaacaucgagaagggcaacaagaccgcguacgacuucgucaaggagaaguucggggaguccggcgccgacaacagccuggagcacuaccucaacaacaucgaggaccuguucaaguccgggaagaucagcaagaccaaguacaacaagcugaagauggccgagcaggacauccccgacggcuucaucgagcgggaccuccgcaacacccaguacaucgccaagaaggcccuguccaugcugaacgagaucagccaccgggugguggcgacguccggcagcgucaccgacaagcuccgcgaggacuggcagcugaucgacgugaugaaggagcugaacugggagaaguacaaggcccucgggcugguggaguacuucgaggaccgggacggccgccagaucgggcggaucaaggacuggaccaagcgcaacgaccaccggcaccacgccauggacgcccugaccgucgccuucacgaaggacguguucauccaguacuucaacaacaagaacgcgucccucgaccccaacgccaacgagcacgccaucaagaacaaguacuuccagaacggccgcgccaucgccccgaugccccugcgggaguuccgcgcggaggccaagaagcaccuggagaacacccucaucagcaucaaggccaagaacaaggugaucaccgggaacaucaacaagacccggaagaagggcggcgucaacaagaacaugcagcagacgccccgcgggcagcugcaccuggagaccaucuacggcuccgggaagcaguaccucaccaaggaggagaaggugaacgccagcuucgacaugcgcaagaucggcaccguguccaagcuggcguaccgggacgcccugcucaagcgccuguacgagaacgacaacgaccccaagaaggccuucgccgggaagaacagccuggacaagcagccgaucuggcucgacaaggagcagaugcggaagguccccgagaaggugaagaucgugacgcuggaggccaucuacaccauccgcaaggagaucucccccgaccugaaggucgacaaggugaucgacgugggcguccggaagauccucaucgaccgccugaacgaguacggcaacgacgcgaagaaggccuucagcaaccuggacgagaaccccaucuggcucaacaaggagaaggggaucagcaucaagcgggugaccaucuccggcaucagcaacgcccagucccugcacgugaagaaggacaaggacgggaagccgauccuggacgagaacggccgcaacauccccgucgacuucgugaacaccgggaacaaccaccacguggccgucuacuaccggcccgugaucgacaagcgcggccagcucguggucgacgaggccggcaaccccaaguacgagcuggaggaggugguggucagcuucuucgaggcggugacgcgggccaaccuggggcagccgaucaucgacaaggacuacaagaccaccgagggcuggcaguuccucuucuccaugaagcagaacgaguacuucguguuccccaacgagaagaccggguucaaccccaaggagaucgaccugcuggacgucgagaacuacggccucaucagcccgaaccuguuccgcgugcagaaguucucccugaagaacuacguguuccggcaccaccucgagacgaccaucaaggacaccagcuccauccugcgcgggaucaccuggaucgacuuccggagcuccaagggccuggacacgaucgucaaggugcgcgucaaccacaucggccagaucgugagcgugggggaguacuga

SEQ ID NO: 2203 - RNA, 4311 nt, Artificial Sequence
  Cas9 variant
augaagcgcauccugggccucgaccuggggaccaacagcaucggcugggcccuggugaacgaggccgagaacaaggacgagcgguccagcaucgucaagcucggggugcgcgugaacccccugaccgucgacgagcugacgaacuucgagaagggcaaguccaucaccaccaacgcggaccggacccucaagcgcgggaugcggcgcaaccugcagcgguacaagcugcgccgggagacgcucaccgaggugcugaaggagcacaagcugaucaccgaggacaccauccucagcgagaacggcaaccgcacgaccuucgagaccuaccggcugcgcgccaaggccgugaccgaggagaucucccuggaggaguucgcccggguccuccugaugaucaacaagaagcgcggcuacaagagcucccggaaggccaaggggguggaggagggcacgcugaucgacgggauggacaucgcgcgcgagcucuacaacaacaaccugaccccgggcgagcugugccuccagcugcuggacgccgggaagaaguuccuccccgacuucuaccggagcgaccugcagaacgagcuggaccgcaucugggagaagcagaaggaguacuaccccgagauccucaccgacgugcugaaggaggagcugcggggcaagaagcgcgacgccgucugggccaucugcgcgaaguacuucguguggaaggagaacuacaccgaguggaacaaggagaagggcaagacggagcagcaggagcgggagcacaagcucgaggggaucuacuccaagcgcaagcgcgacgaggccaagcgggagaaccugcaguggcgcgugaacggccugaaggagaagcucagccuggagcagcuggucaucguguuccaggagaugaacacccagaucaacaacuccagcggguaccucggcgccaucuccgaccggagcaaggagcuguacuucaacaagcagaccgugggccaguaccagauggagaugcuggacaagaaccccaacgccucccuccgcaacauggucuucuaccggcaggacuaccuggacgaguucaacaugcugugggagaagcaggccguguaccacaaggagcucaccgaggagcugaagaaggagauccgcgacaucaucaucuucuaccagcggcgccucaagagccagaaggggcugaucggcuucugcgaguucgagucccggcagaucgagguggacaucgacgggaagaagaagaucaagacggucggcaaccgcgugaucagccgguccagcccgcuguuccaggaguucaagaucuggcagauccugaacaacaucgaggugaccgucguggggaagaagcgcaagcggcgcaagcucaaggagaacuacagcgcgcuguucgaggagcugaacgacgccgagcagcuggagcucaacggcucccggcgccugugccaggaggagaaggagcugcucgcccaggagcuguucauccgggacaagaugaccaagagcgaggugcugaagcuccuguucgacaacccccaggagcuggaccucaacuucaagaccaucgacggcaacaagacgggguacgcccuguuccaggccuacuccaagaugaucgagaugagcggccacgagcccgucgacuucaagaagcccguggagaaggucguggaguacaucaaggcgguguucgaccugcucaacuggaacaccgacauccugggguucaacuccaacgaggagcuggacaaccagccguacuacaagcucuggcaccuccuguacagcuucgagggcgacaacacccccaccgggaacggccgccugauccagaagaugacggagcuguacggcuucgagaaggaguacgccaccauccuggccaacgucuccuuccaggacgacuacgggagccucuccgccaaggccauccacaagauccugccccaccugaaggagggcaaccgguacgacguggcgugcguguacgccggguaccgccacagcgaguccagccucacccgcgaggagaucgccaacaagguccugaaggaccggcugaugcuccugcccaagaacucccugcacaacccggugguggagaagauccucaaccagauggucaacgugaucaacgugaucaucgacaucuacggcaagcccgacgagauccgcgucgagcuggcccgggagcugaagaagaacgccaaggagcgcgaggagcucaccaagagcaucgcgcagacgaccaaggcccacgaggaguacaagacccugcugcagaccgaguucgggcucacgaacgugucccggaccgacauccugcgcuacaagcuguacaaggagcucgagagcugcggcuacaagacccuguacuccaacaccuacaucagccgggagaagcuguucuccaaggaguucgacaucgagcacaucaucccccaggcccgccucuucgacgacagcuucagcaacaagacccuggaggcccgguccgugaacaucgagaagggcaacaagacggcguacgacuucgucaaggagaaguucggggagagcggcgccgacaacucccuggagcacuaccucaacaacaucgaggaccuguucaagagcgggaagaucuccaagaccaaguacaacaagcugaagauggccgagcaggacauccccgacggcuucaucgagcgcgaccuccggaacacccaguacaucgccaagaaggcccugagcaugcugaacgagaucucccaccgcgugguggcgaccagcggcuccgucacggacaagcuccgggaggacuggcagcugaucgacgugaugaaggagcugaacugggagaaguacaaggcccucgggcugguggaguacuucgaggaccgcgacggccggcagaucgggcgcaucaaggacuggaccaagcggaacgaccaccgccaccacgccauggacgcccugaccgucgccuucaccaaggacguguucauccaguacuucaacaacaagaacgcgagccucgacccgaacgccaacgagcacgccaucaagaacaaguacuuccagaacggccgggccaucgcccccaugccccugcgcgaguuccgggcggaggccaagaagcaccuggagaacacgcucaucuccaucaaggccaagaacaaggugaucaccgggaacaucaacaagacccgcaagaagggcggcgucaacaagaacaugcagcagacgccccgcgggcagcugcaccuggagaccaucuacggcagcgggaagcaguaccucaccaaggaggagaaggugaacgccuccuucgacaugcggaagaucggcaccgugagcaaguccgcguaccgcgacgcccugcugaagcggcucuacgagaacgacaacgacccgaagaaggccuucgccgggaagaacagccuggacaagcagcccaucuggcuggacaaggagcagaugcgcaagguccccgagaaggugaagaucgugacccucgaggccaucuacacgauccggaaggagaucuccagcgaccugaaggucgacaaggugaucgacgugggcguccgcaagauccugaucgaccggcucaacgaguacggcaacgacgcgaagaaggccuucagcaaccuggacaagaaccccaucuggcugaacaaggagaaggggaucuccaucaagcgcgugaccaucagcggcaucuccaacgcccagagccuccacgugaagaaggacaaggacgggaagccgauccuggacgagaacggccggaacauccccgucgacuucgugaacaccgggaacaaccaccacguggccgucuacuaccgccccgugaucgacaagcggggccagcugguggucgacgaggccggcaaccccaaguacgagcucgaggaggugguggucuccuucuucgaggcggugacccgcgccaaccuggggcugccgaucaucgacaaggacuacaagacgaccgagggcuggcaguuccucuucagcaugaagcagaacgaguacuucguguuccccaacgagaagaccggguucaaccccaaggagaucgaccugcuggacgucgagaacuacggccucaucuccccgaaccuguuccgggugcagaaguucagccugaagaacuacguguuccgccaccaccucgagaccacgaucaaggacaccuccagcauccugcgggggaucaccuggaucgacuuccgcuccagcaagggccuggacaccaucgucaaggugcgggucaaccacaucggccagaucguguccgugggggaguacuga

SEQ ID NO: 2204 - RNA, 4311 nt, Artificial Sequence
  Cas9 variant
augaagcgcauccugggccucgaccuggggaccaacagcaucggcugggcccuggugaacgaggccgagaacaaggacgagcgguccagcaucgucaagcucggggugcgcgugaacccccugaccgucgacgagcugacgaacuucgagaagggcaaguccaucaccaccaacgcggaccggacccucaagcgcgggaugcggcgcaaccugcagcgguacaagcugcgccgggagacgcucaccgaggugcugaaggagcacaagcugaucaccgaggacaccauccucagcgagaacggcaaccgcacgaccuucgagaccuaccggcugcgcgccaaggccgugaccgaggagaucucccuggaggaguucgcccggguccuccugaugaucaacaagaagcgcggcuacaagagcucccggaaggccaaggggguggaggagggcacgcugaucgacgggauggacaucgcgcgcgagcucuacaacaacaaccugaccccgggcgagcugugccuccagcugcuggacgccgggaagaaguuccuccccgacuucuaccggagcgaccugcagaacgagcuggaccgcaucugggagaagcagaaggaguacuaccccgagauccucaccgacgugcugaaggaggagcugcggggcaagaagcgcgacgccgucugggccaucugcgcgaaguacuucguguggaaggagaacuacaccgaguggaacaaggagaagggcaagacggagcagcaggagcgggagcacaagcucgaggggaucuacuccaagcgcaagcgcgacgaggccaagcgggagaaccugcaguggcgcgugaacggccugaaggagaagcucagccuggagcagcuggucaucguguuccaggagaugaacacccagaucaacaacuccagcggguaccucggcgccaucuccgaccggagcaaggagcuguacuucaacaagcagaccgugggccagugccagauggagaugcuggacaagaaccccaacgccucccuccgcaacauggucuucuaccggcaggacuaccuggacgaguucaacaugcugugggagaagcaggccguguaccacaaggagcucaccgaggagcugaagaaggagauccgcgacaucaucaucuucuaccagcggcgccucaagagccagaaggggcugaucggcuucugcgaguucgagucccggcagaucgagguggacaucgacgggaagaagaagaucaagacggucggcaaccgcgugaucagccgguccagcccgcuguuccaggaguucaagaucuggcagauccugaacaacaucgaggugaccgucguggggaagaagcgcaagcggcgcaagcucaaggagaacuacagcgcgcuguucgaggagcugaacgacgccgagcagcuggagcucaacggcucccggcgccugugccaggaggagaaggagcugcucgcccaggagcuguucauccgggacaagaugaccaagagcgaggugcugaagcuccuguucgacaacccccaggagcuggaccucaacuucaagaccaucgacggcaacaagacgggguacgcccuguuccaggccuacuccaagaugaucgagaugagcggccacgagcccgucgacuucaagaagcccguggagaaggucguggaguacaucaaggcgguguucgaccugcucaacuggaacaccgacauccugggguucaacuccaacgaggagcuggacaaccagccguacuacaagcucuggcaccuccuguacagcuucgagggcgacaacacccccaccgggaacggccgccugauccagaagaugacggagcuguacggcuucgagaaggaguacgccaccauccuggccaacgucuccuuccaggacgacuacgggagccucuccgccaaggccauccacaagauccugccccaccugaaggagggcaaccgguacgacguggcgugcguguacgccggguaccgccacagcgaguccagccucacccgcgaggagaucgccaacaagguccugaaggaccggcugaugcuccugcccaagaacucccugcacaacccggugguggagaagauccucaaccagauggucaacgugaucaacgugaucaucgacaucuacggcaagcccgacgagauccgcgucgagcuggcccgggagcugaagaagaacgccaaggagcgcgaggagcucaccaagagcaucgcgcagacgaccaaggcccacgaggaguacaagacccugcugcagaccgaguucgggcucacgaacgugucccggaccgacauccugcgcuacaagcuguacaaggagcucgagagcugcggcuacaagacccuguacuccaacaccuacaucagccgggagaagcuguucuccaaggaguucgacaucgagcacaucaucccccaggcccgccucuucgacgacagcuucagcaacaagacccuggaggcccgguccgugaacaucgagaagggcaacaagacggcguacgacuucgucaaggagaaguucggggagagcggcgccgacaacucccuggagcacuaccucaacaacaucgaggaccuguucaagagcgggaagaucuccaagaccaaguacaacaagcugaagauggccgagcaggacauccccgacggcuucaucgagcgcgaccuccggaacacccaguacaucgccaagaaggcccugagcaugcugaacgagaucucccaccgcgugguggcgaccagcggcuccgucacggacaagcuccgggaggacuggcagcugaucgacgugaugaaggagcugaacugggagaaguacaaggcccucgggcugguggaguacuucgaggaccgcgacggccggcagaucgggcgcaucaaggacuggaccaagcggaacgaccaccgccaccacgccauggacgcccugaccgucgccuucaccaaggacguguucauccaguacuucaacaacaagaacgcgagccucgacccgaacgccaacgagcacgccaucaagaacaaguacuuccagaacggccgggccaucgcccccaugccccugcgcgaguuccgggcggaggccaagaagcaccuggagaacacgcucaucuccaucaaggccaagaacaaggugaucaccgggaacaucaacaagacccgcaagaagggcggcgucaacaagaacaugcagcagacgccccgcgggcagcugcaccuggagaccaucuacggcagcgggaagcaguaccucaccaaggaggagaaggugaacgccuccuucgacaugcggaagaucggcaccgugagcaaguccgcguaccgcgacgcccugcugaagcggcucuacgagaacgacaacgacccgaagaaggccuucgccgggaagaacagccuggacaagcagcccaucuggcuggacaaggagcagaugcgcaagguccccgagaaggugaagaucgugacccucgaggccaucuacacgauccggaaggagaucucccccgaccugaaggucgacaaggugaucgacgugggcguccgcaagauccugaucgaccggcucaacgaguacggcaacgacgcgaagaaggccuucagcaaccuggacaagaacccgaucuggcugaacaaggagaaggggaucagcaucaagcgcgugaccaucuccggcaucagcaacgcccagucccuccacgugaagaaggacaaggacgggaagcccauccuggacgagaacggccggaacauccccgucgacuucgugaacaccgggaacaaccaccacguggccgucuacuaccgccccgugaucgacaagcggggccagcugguggucgacgaggccggcaacccgaaguacgagcucgaggaggugguggucagcuucuucgaggcggugacccgcgccaaccuggggcugcccaucaucgacaaggacuacaagacgaccgagggcuggcaguuccucuucuccaugaagcagaacgaguacuucguguuccccaacgagaagaccggguucaacccgaaggagaucgaccugcuggacgucgagaacuacggccucaucagccccaaccuguuccgggugcagaaguucucccugaagaacuacguguuccgccaccaccucgagaccacgaucaaggacaccagcuccauccugcgggggaucaccuggaucgacuuccgcagcuccaagggccuggacaccaucgucaaggugcgggucaaccacaucggccagaucgugagcgugggggaguacuga

SEQ ID NO: 2205 - RNA, 4311 nt, Artificial Sequence
  Cas9 variant
augaagcgcauccugggccucgaccuggggaccaacagcaucggcugggcccuggugaacgaggccgagaacaaggacgagcgguccagcaucgucaagcucggggugcgcgugaacccccugaccgucgacgagcugacgaacuucgagaagggcaaguccaucaccaccaacgcggaccggacccucaagcgcgggaugcggcgcaaccugcagcgguacaagcugcgccgggagacgcucaccgaggugcugaaggagcacaagcugaucaccgaggacaccauccucagcgagaacggcaaccgcacgaccuucgagaccuaccggcugcgcgccaaggccgugaccgaggagaucucccuggaggaguucgcccggguccuccugaugaucaacaagaagcgcggcuacaagagcucccggaaggccaaggggguggaggagggcacgcugaucgacgggauggacaucgcgcgcgagcucuacaacaacaaccugaccccgggcgagcugugccuccagcugcuggacgccgggaagaaguuccuccccgacuucuaccggagcgaccugcagaacgagcuggaccgcaucugggagaagcagaaggaguacuaccccgagauccucaccgacgugcugaaggaggagcugcggggcaagaagcgcgacgccgucugggccaucugcgcgaaguacuucguguggaaggagaccuacacggaguggaacaaggagaagggcaagaccgagcagcaggagcgggagcacaagcucgaggggaucuacuccaagcgcaagcgcgacgaggccaagcgggagaaccugcaguggcgcgugaacggccugaaggagaagcucagccuggagcagcuggucaucguguuccaggagaugaacacccagaucaacaacuccagcggguaccucggcgccaucuccgaccggagcaaggagcuguacuucaacaagcagaccgugggccaguaccagauggagaugcuggacaagaaccccaacgccucccuccgcaacauggucuucuaccggcaggacuaccuggacgaguucaacaugcugugggagaagcaggccguguaccacaaggagcucacggaggagcugaagaaggagauccgcgacaucaucaucuucuaccagcggcgccucaagagccagaaggggcucaucggcuucugcgaguucgagucccggcagaucgagguggacaucgacgggaagaagaagaucaagaccgucggcaaccgcgugaucagccgguccagcccgcuguuccaggaguucaagaucuggcagauccugaacaacaucgaggugaccgucguggggaagaagcgcaagcggcgcaagcucaaggagaacuacagcgcgaucuucgaggagcugaacgacgccgagcagcuggagcugaacggcucccggcgccucugccaggaggagaaggagcugcuggcccaggagcuguucgugcgggacaagaugaccaagagcgagguccugaagcuccuguucgacaacccccaggagcuggaccugaacuucaagacgaucgacggcaacaagaccggguacgcccucuuccaggccuacuccaagaugaucgagaugagcggccacgagcccguggacuucaagaagcccgucgagaaggugguggaguacaucaaggcggucuucgaccugcugaacuggaacaccgacauccucggguucaacuccaacgaggagcuggacaaccagagcuacuacaagcuguggcaccuccuguacuccuucgagggcgacaacaccccgacggggaacggccgccugauccagaagaugaccgagcucuacggcuucgagaaggaguacgccaccauccuggccaacgugagcuuccaggacgacuacgggucccugagcgccaaggccauccacaagauccucccccaccugaaggagggcaaccgguacgacguggcgugcgucuacgccggguaccgccacuccgagagcucccugacccgcgaggagaucgccaacaaggugcucaaggaccggcugaugcugcuccccaagaacagccugcacaaccccguggucgagaagauccugaaccagauggugaacgugaucaacgucaucaucgacaucuacggcaagccggacgagauccgcguggagcucgcccgggagcugaagaagaacgccaaggagcgcgaggagcugacgaaguccaucgcgcagaccaccaaggccaacgaggaguacaagacccuccugcagacggaguucgggcugaccaacgugagccggaccgacauccuccgcuacaagcuguacaaggagcuggaguccugcggcuacaagacccucuacagcaacaccuacaucucccgggagaagcuguucagcaaggaguucgacaucgagcacaucaucccccaggcccgccuguucgacgacagcuucuccaacaagacgcucgaggcccggagcgucaacaucgagaagggcaacaagaccgcguacgacuucgugaaggagaaguucggggaguccggcgccgacaacagccuggagcacuaccugaacaacaucgaggaccucuucaaguccgggaagaucagcaagaccaaguacaacaagcugaagauggccgagcaggacauccccgacggcuucaucgagcgcgaccugcggaacacccaguacaucgccaagaaggcccucuccaugcugaacgagaucagccaccgcguggucgcgacguccggcagcgugaccgacaagcugcgggaggacuggcagcucaucgacgugaugaaggagcugaacugggagaaguacaaggcccuggggcucgucgaguacuucgaggaccgcgacggccggcagaucgggcgcaucaaggacuggaccaagcggaacgaccaccgccaccacgccauggacgcccugaccguggccuucacgaaggacguguucauccaguacuucaacaacaagaacgcgucccuggaccccaacgccaacgagcacgccaucaagaacaaguacuuccagaacggccgggccaucgccccgaugccccuccgcgaguuccgggcggaggccaagaagcaccuggagaacacccugaucagcaucaaggccaagaacaaggucaucaccgggaacaucaacaagacccgcaagaagggcggcgugaacaagaacaugcagcagacgccccgcgggcagcuccaccuggagaccaucuacggcuccgggaagcaguaccugaccaaggaggagaaggugaacgccagcuucgacaugcggaagaucgagaccgucuccaagagcgcguaccgcgacgcccuccugaagcggcuguacgagaacgacaacgaccccaagaaggccuucgccggcaagaacucccucgacaagcagccgaucuggcuggacaaggagcagaugcgcaaggugcccgagaaggugaagaucgucacgcuggaggccaucuacaccauccggaaggagaucagccccgaccucaagguggacaaggugaucgacgucggggugcgcaagauccugaucgaccggcugaacgaguacggcaacgacgcgaagaaggccuucagcaaccucgacaagaaccccaucuggcugaacaaggagaagggcaucuccaucaagcgcgugaccaucagcgggaucuccaacgcccagagccugcacgucaagaaggacaaggacggcaagccgauccucgacgagaacgggcggaacauccccguggacuucgugaacaccggcaacaaccaccacgucgccguguacuaccgccccgugaucgacaagcgggggcagcuggucguggacgaggccggcaaccccaaguacgagcuggaggagguggucguguccuucuucgaggcggugacgcgcgccaaccucggccugccgaucaucgacaaggacuacaagaccaccgagggguggcaguuccuguucagcaugaagcagaacgaguacuucgucuuccccaacgagaagaucggcuucaaccccaaggagaucgaccuccuggacguggagaacuacgggcugaucuccccgaaccucuuccgggugcagaaguucagccugaagaacuacgucuuccgccaccaccuggagaccacgaucaaggacaccuccagcauccuccggggcaucaccuggaucgacuuccgcuccagcaaggggcuggacaccaucgugaagguccgggugaaccacaucggccagaucguguccgucggcgaguacuga

SEQ ID NO: 2206 - RNA, 4311 nt, Artificial Sequence
  Cas9 variant
augaagcgcauccugggccucgaccuggggaccaacagcaucggcugggcccugguggacgaggccgagaacaaggacgagcgguccagcaucgucaagcucggggugcgcgugaacccccugaccgucgacgagcugacgaacuucgagaagggcaaguccaucaccaccaacgcggaccggacccucaagcgcgggaugcggcgcaaccugcagcgguacaagcugcgccgggagacgcucauggaggugcugaaggagcacaagcugaucaccgaggacaccauccucagcgagaacggcaaccgcaccacguucgagaccuaccggcugcgcgccaaggccgccaccgagaagaucucccuggaggaguucgcccgggugcuccugaugaucaacaagaagcgcggcuacaagagcugccggaaggcgaagggggccgaggagggcacccugaucgacgggauggacaucgcccgcgagcucuacaacaacaaccugacgccgggcgagcugugccuccagcugcuggacgccgggaagaaguaccuccccgacuucuaccgguccgaccugcagaacgagcuggaccgcaucugggagaagcagaaggaguacuaccccgagauccucaccgagguccugaaggaggagcugcggggcaagaagcgcgacgcggugugggccaucugcgccaagagcuucgugugggaggaguacuacaccgaguggaacaaggagaagggcaagaccgagcagcaggagcgggagcacaagcucgaggggaucuacuccaagcgcaagcgcgacgaggccaagcgggagaaccugcaguggcgcgucaacggccugaaggagaagcucagccuggagcagcuggugaucgugcuccaggagaugaacauccagaucaacaacuccagcggguaccugggcgccaucuccgaccggagcaaggagcuguacuucaacaagcagacggucggccaguaccagauggagaugcucgacaagaaccccaacgcgucccugcgcaacaugguguucuaccggcaggacuaccuggacgaguucaacacccucugggagaagcaggccgaguaccacaaggagcugaccggggagcugaagaaggagauccgcgacaucgugaucuucuaccagcggcgccucaagagccagaagggccuggucggguucugcgaguucgagucccggcagaucgagguggagaucgacggcaagaagaagaucaagaccguggggaaccgcgucaucccgcggagcagcccccuguuccaggaguucaagaucuggcagauccucaacaacaucgaggugacgguggucggcaagaagggcaagcgccggaagcagaaggacaacucccccacccuguucgacgggcuggacgacaccgagcagcuggagcucaacggcagccgcuaccuguaccaggaggagaaggagcugcucgcccaggagcuguucgugcgggacaagaugaccaaguccgacgugcugaagcuccuguucgacaacccccaggagcuggaccucaacuucaagacgaucgacgggaacaagaccggcuacacccuguuccaggccuacagcaagaugaucgagauguccgggcacgagccggucgacuucaagaagaccguggagaaggucguggagcacgugaaggccgucuucgaccugcucaacuggaacacggacauccugggcuucaacagcaacgaggagcuggacaaccaguccuacuacaagcucuggcaccuccuguacagcuucgagggcgacaacacccccaccgggaacgcgcgccuggugcagaagaucaccgagcuguacggcuucgagaaggaguacgccaucauccuggccaacgugacguuccaggacgacuacgggucccucagcgccaaggccauccacaagauccugccccaccugaaggagggcaaccgguacgacgucgcgugcgccuacgccggguacaagcacuccgagagcucccucaccaaggaggagaucgccaacaaggcccugaaggaccgccugacccuccugcccaagaacaaccugcggaacccggugguggagaagauccucaaccagauggucaacgugaucaacgcgaucaucgacaccuacggcaagcccgacgagauccgcguggagcuggcccgcgagcugaagaagaacgccaaggagcgggaggagcucacgaaguucaucgccgagaccacccgcaagcacgaggaguucaagauccugcugcagagcgaguucggccucaccaacgucucccggaccgacauccugcgcuacaagcuguacaaggagcucgagagcugcggguacaagacgcuguacuccaacaccuacaucccccgggagaagcuguucagcaaggaguucgacaucgagcacaucaucccccaggcgcgccucuucgacgacuccuucagcaacaagacccuggaggcccgguccaucaaccuggagaagggcaacaagaccgccuacgacuucgugaaggagaaguucggggagagcggcgccgacaacagccucgaccacuaccugaacaacaucgaggaccuguucaaguccggcaagaucagcaagacgaaguacaacaagcucaagauggccgagcaggacaucccggacggguucaucaaccgcgaccugcggaacacccaguacaucgcgaagaaggcccuguccaugcucaacgagaucagccgccggguggucgccaccuccggcaccaucacggacaagcugcgccaggacuggcagcugguggacgugaugaaggagcucaacugggagaaguacaaggcccuggggcuggucgaguacuucgaggacaaggacggccggcagaucgggcgcaucaaggacuggaccaagcggaacgaccaccgccaccacgccauggacgcgcucaccguggccuucaccaaggacaucuucauccaguacuucaacaacaagaacgccagccugaacuccaacacgaacgaguacgccaucaagaacaaguacuuccagaacggccgggccaucgcgcccaucccccugcgcgaguuccggguggaggccaagaagcaccucgagaacacccugaucagcaucaaggccaagaacaaggucgugaccggcaacaucaacaagaccaagaagcgcgggggcgugaacaaguaccugcagcagacgccccgggggcagcuccaccuggagaccaucuacggcuccgggaagcaguaccugaccaaggaggagaaggucaacgccagcuucgacaugaagaagaucgcgaccguguccaagagcgccuaccgcgacgugcuccugaagcgccugcacgagaacgacaacgacccgaagaaggccuucacgggcaagaacucccucgacaagcagcccaucuggcuggacaaggagcagacccggaagguccccgagaaggugaagaccgugacccuggagacgaucuacaccguccgcaaggagaucagccccgaccucaagguggacaaggugaucgacgccggcguccggaagauccugaccgggcgccugaacgaguacggcaacgacgccaagaaggcguucuccaaccucgacgagaacccgaucuggcugaacaaggagaaggggaucagcaucaagcgggugaccaucuccggcaucagcaacgcccagagccugcacgugaagaaggacaaggacgggaagcccauccucgacgaggacucccgcaacauccccgucgacuucgugaacacgggcaacaaccaccacguggccgucuaccggcgccccgugaucgacaagcggggccagcuggugaucgacgaggccgggaacccgaaguacgagcuggaggaggucguggugagcuucuucgaggccgucacccgcgcgaaccucggccagcccaucaucgacaaggacuacaagaccuccgagggguggcaguuccuguucagcaugaagcagaacgaguacuucguguuccccaacgagaagaccggcuucaacccgaaggagaucgaccugcucgacgccgagaacuacggggugaucucccccaaccuguuccggguccagaaguucgcccacaagaacuacguguuccgccaccaccuggagacgaccaucaaggacaccagcuccauccucaagggcaucaccuggaucgacuuccggagcuccaagggccuggacgccaucgugaagguccgcgugaaccacaucgggcagaucgucagcgugggcgaguacuga

SEQ ID NO: 2207 - RNA, 4311 nt, Artificial Sequence
  Cas9 variant
augaaguacaucaaguacauccugggccucgacaucgggagcaacuccaucggcugggcccugauccagcuggaccuccugcagaagaccaagcgcaucaucgccgcggggagccggaucauccccauggaccagaaggugcuguccgacuucggcaaggggaucaccaucagcccgacggcccagcgcaccuccuaccggaacgcccgccacugccgggagcgccaccuccugcggcgcgagcggcugcaccgcguccuccacauccugggcuuccugcccacccacuacgacaagcagaucgacuucagcaagcgguacggcaaguucguggacaacaccgagcccaagaucgccuacaacgaggggaaguuccucuucauggacuccuuccaggagaugcugagcgacuucaagucccaccagcccgaccuguucuacacgaagaagaacggcgaggagagcaagaucccguacgacuggaccaucuacuaccuccgcaagaaggcccugucccagaagaucagcaaggaggagcuggcguggaucauccucaacuucaaccagaagcggggguacuaccagcugcgcgaggaggagggcaacaaggagaacgacuucgagaucaucuccagcaagaucaucuccgugaucaagaaggacaaggacaagaaguacaacaaguacugguacgacaucauccuggagaacgggcucgucuaccaggccgccuucuacaacgacuucguguacaacuggaucaaccaggaccgggaguucaucaucgagcgcaccagccugaagaacggcgccgagaaggugaagcuguccuaccuccccaccuucgacgagaucgacaagauggacaagaaggagcaggacaaguacuacaagaagaucaagaucaagacggagaacagcaucggcaacaagaccgucgggugcuacaucuacgaccacauccugcagaaccccaacgagaagaucaagggcaagcuggugcggaccaucgagcgcaaguacuacaaggaggagcucaaggcgauccuggagaagcagaucgcccugcagcccgagcuguucaccgaccagcugcuggccgacugcauccgggagcucuacuccaagaacgaggcccagcagcgcaaccuggccgcgcgggacuucgugcaccuccucgucgaggacaucaucuucuaccagcgcccgcugcgccggcagaaguccacgcuggccaacugcagccucgagagccgcagcuacaucgacaaggacucccacacccggaaggaggcgccccugaaggugugccccaagagcaaccccuacuaccaggaguuccgcgugcugcaguggcuccagaaccugaagaucuacgagaucgacuccgaccaggaggucacccaccaguucaucaagacccuggaggacaagcagcagcuguucgaguuccugauggcccagaaggagaucgacugcgaggagcugcucaaguacuuccugaaccagacguacccgaacgccaaggagaaggcccucaagagcgagcugaagaaguggaaggacaccuaccgguggaacuacguguacgacaucggggagaaguccagcaagaaguaccccaugaacgagacccgcuacgagcucaagcggcaccuggagaagguggccaaccugcccgacgacuuccucuccagcgaggucgaguaccugcuguggcaccucaucuacuccgugaaggacaagguggccuacgagaagggccugaagaaguucgcccagaagcaccaccuggacaaggacagcuucgucgaguccuucaagaaguucaaccccuacccgagcgaguacggcuccuucagcgagaaggccauccgcaagcuccugccccugaugcgguucggggcgcacugggacuucaaccacaucgacaagaacacccagaagcgcaucgaggaccucaucacgggcguggagaacgaggagauccggaccauccugcgcgagaaggccgagaaguaccagcuggagaaggagaccgacuuccaggaccucccccuguggcuggcccaguacaucguguacaaccggcacgccgaggccuccagccucgagaaguggaccuccgucaacgaccuggagacguaccugaacgaguucaagcagcacagccuccgcaaccccaucguggagcaggucgugauggagacccugcgggugguccgcgacaucuggcagcaguacgggcagggccaggcgagcuucuucaacgagauccacaucgagcuggggcgggagcucaagaagaccgccaaggagcgcgagaagcuguccaagcagaaccagaagaacgaggacaucaaccugagcaucaaggagaagcucaaggagcuggagaaguacaacacccgggccuacuccaucacgcaccaggagaaguacaagcuguggcucgagcagaagcacaucagcccguacaccggccagaucaucucccccgagaaccuguucaccgacaacuacgagaucgagcacaucaucccccagagccgcuucuucgacgacucccugagcaacaagguggugugcgaguccaucgucaacaaggcccccuacaaggaccgccagcucggccuggaguucaucaagaaccagggcgggcggaucgugaaggagcugagcaaggagaacaagaccaucaagaucuucacggaggagcaguaccgcaccuucaucaaggagcacuacuccaacaacccggagaagaccaagaagcuccugcuggaggagauccccgagaagaugguggcgcggcagaugaacgacacgugcuacaucagcaaguucaucuccgagauccucagcaagaucguccgcuccgacgagcaggacgagggggugcacagcaagaacgugauccugugcaccggcaagaucaccuccauccugcggcaggacugggggcucaacgacaucugggacaaccugauccugccccgcuucgagcggaugaacaaccuccugcagaaggagaaguucaccaucuacagcaucgagaagcagaagaagauccccgucgugccgaucaacgaccaguucaagagcuuccagaagaagcgcaucgaccaccggcaccacgccauggacgccaucaucaucgccugcaccacccgcgagcacaucaacuacaucaacaaccagcacgcccuggagaaggagaaggacaagaaggagaagcaggaggagcgggacaagcuccgcgagaagcugugcaucaagaaguacaacaaccgguccgagggcaacuacagcuggaucuucaagaagcccugggacacguucacccaggaggugcgcgucgcgcuggaggacaucgugguguccuucaagcagaaccuccgggucaucaacaaggccaccaacuacuacgagcgcuggguggaggagaacggcaaguacaucaagaagauggugaagcaggaggggaccaacugggccauccggaagccccugcacgaggagacgaucagcggcaagaucuaccuggaccgcgagaagaucaccaagaacgacauccucaccgccacccggaagacggucgacuccagcuucgacgacaagcgcaucaagaagaucaccgacaccgggauccagaagauccugcugaacuaccucaaguacaagggcuccccggagaucgccuucagccccgaggggcuggaggagcugaacaagaaccucuccaucuacaacgacggcaagccccacaagcccaucuacaaggugcggaucuacgagaagggcagcgggcgcuucgcgcugggcgagaaggggcgcaaguacaagaaguacgugcagggcgccuccaaccuguacuucggcaucuaccagggggccaagcggagcuucgccaccaucccgcucaacgaggucaucgagcgccagaagcagggccugcccuccgugcccgaguacaacgagaagggggaccugcuccuguucagccugucccccaacgaccucguguacgucccgaucgagggcgagaucaucgagaacaucgacuuccggaaccugagcaaggagcagaaggagcgcaucuacaacgugaacgacuucuccagcacgugcuacuucacccccaaccggaucgccaaggcgaucuuccccaaggagguggaccugcagcgcaagggggacaagcucuccggcagcuacgacaccaagaccgccagccuggagggcauccagaucaaggaggucugcaucaagcugaagguggaccggcucgggaacaucuccaaggccuga

SEQ ID NO: 2208 - RNA, 4314 nt, Artificial Sequence
  Cas9 variant
augaaguacaucaaguacauccugggccucgacaucgggagcaacuccaucggcugggcccugauccagcuggaccuccugcagaagaccaagcgcaucaucgccaccgggagccggaucauccccauggaccagaaggugcuguccgacuucggcaaggggaucacgaucagcccgaccgcgcagcgcaccuccuaccggaacgcccgccacugccgggagcgccaccuccugcggcgcgagcggcugcaccgcguccuccacauccugggcuuccugcccacccacuacgacaagcagaucgacuucagcaagcgguacggcaaguucguggacaacacggagcccaagaucgccuacaacgagcgcaaguuccucuucauggacuccuuccaggagaugcuggccgacuucaagauccaccagcccgaccuguucuacaccaagaagaacggggaggagagcaagaucccguacgacuggaccaucuacuaccuccggaagaaggcccugucccgcaagaucagcaaggaggagcuggcguggaucauccucaacuucaaccagaagcggggcuacuaccagcugcgcgaggaggaggaggagaacaaggagaacgacuucgagaucaucuccagcaagaucaucuccgugaucaagaaggacaaggacaagaaguacaacaaguacugguacgacaucauccuggagaacgggcucgucuaccaggccgccuucuacaacgacuucguguacaacuggaucaaccaggaccgggaguucaucaucgagcgcaucagccugaagaacggcaccgagaaggugaagcuguccuaccuccccacguucgacgagaucgacaagauggacaagaaggagcaggacaaguacuacaagaagaucaagaucaagaccgagaacagcaucgggaacaagaccgucggcugcuacaucuacgaccacauccugcagaaccccaacgagaagaucaagggcaagcuggugcggaccaucgagcgcaaguacuacaaggaggagcucaaggccauccuggagaagcaggucgcgcugcagcccgagcuguucacggaccagcuguucgccgacugcauccgggagcuguacuccaagaacgaggcccagcagcgcaaccucgccgcccgcgacuucgugcaccuguucguggaggacaucaucuucuaccagcggagccugcgccggcagaaguccacccucgcgaacugcagccuggagagccgcuccuacaucgacaaggacagccacacccggaaggaggccccgcugaaggugugccccaaguccaaccccuacuaccaggaguuccgcguccuccaguggcugcagaaccugaagaucuacgagaucgacaccgaccaggaggugacgcacgaguucaucaagacccucgaggacaagcagcaguucuucgacuuccugaugaaccagaaggagaucgacugcgaggagcugcucaaguacuuccugaaccagaccuaccccaacgcccgggagaaggcccucaagagcgagcucaagaaguggaaggacaccuaccgcuggaacuacguguacgacaucggggagaaguccagcaagaaguacccgaugaacgagacgcgguacgagcugaagcgccaccuggagaaggucgccaaccugcccgacgacuuccucuccagcgagguggaguaccugcuguggcaccucaucuacuccgugaaggacaaggucgcguacgagaagggccugaagaccuucgcccagaagcaccaccuggacaaggacagcuucguggaguccuucaagaaguucaagcccuaccccagcgaguacggguccuucagcgagaaggccauccggaagcuccugccgcugaugcgcuucggcuccuacugggacuucaaccacaucgacaagaacacccagaagcggaucgaggaccucaucaccggcguggagaacgaggagauccgcacgauccugcgggagaaggccgagaaguaccagcuggagaaggagaccgacuuccaggaccucccccuguggcuggcccaguacaucgucuacaaccgccacgcggaggccagcucccucgagaaguggaccagcgugaacgaccuggagaccuaccugaacgaguucaagcaguacucccuccggaaccccaucguggagcaggucgugauggagacgcugcgcgucgugcgggacaucuggcagcaguacgggcagggccaggccagcuucuucgacgagauccacaucgagcuggggcgcgagcucaagaagaccgccaaggagcgcgagaagcugagcaagcagaaccagaagaacgaggacaucaaccuguccaucaaggagaagcucaaggagcuggagaaguacaacacccgggccuacagcaucacccaccaggagaaguacaagcuguggcucgagcagaagcacaucucccccuacacgggccagaucaucagcccggagaaccuguucaccgacaacuacgagaucgagcacaucaucccccagucccgcuucuucgacgacagccuguccaacaagguggucugcgagagcaucgugaacaaggcgcccuacaaggaccggcagcucgggcuggaguucaucaagaaccagggcggccgcaucgugaaggagcuguccaccgagaacaagaccaucaagaucuucacggaggagcaguaccggaccuucaucaaggagcacuacagcaacaaccccgagaagaccaagaagcuccugcuggaggagaucccggagaagauggucgcccgccagaugaacgacacgugcuacaucuccaaguucaucagcgagauccucuccaagaucgugcggagcgacgagcaggacgagggggugcacuccaagaacgucauccugugcaccggcaagaucaccagcgcccugaagcaggacuggggcgugaacgacguguggaacgaccucauccugccccgcuucgagcggaugaacgaccugacccaguccacccucuucaccacguacaacgagaaguaccagaaguaccugcccaccguccccauggaguacagcaacggguuccagaagaagcgcaucgaccaccggcaccacgccauggacgcgaucaucaucgccugcgccacccgcgagcacaucaacuacaucaacaaccagcacgcccuggagaaggggaaggacaagaaggagaagcagaaggagcacgacaagcuccgggagaagcugugcaucaagaaggacaacaagggcagcgaggagaacuacuccuggaucuucaagaagccgugggacaccuucacgcaggaggugcaggccgcgcuggagggcaucguggucagcuucaagcagaaccuccgcgugaucaacaaggccaccaacuacuacgagcgguggguggaggagaacgggaaguacaucaagaagauggucaagcaggagggcaccaacugggccauccgcaagccccugcacgaggagaccaucuccgggaagaucuaccuggaccgggaggagaucacgaagaacgacauccucaccgccacccgcaagaccguggacagcuccuucgacgagaagcggaucaagaagaucacggacaccggcauccagaagauccugcugaacuaccucaaguacaaggggagccccgagaucgccuucuccccggagggccuggaggagcugaacaagaaccucagcaucuacaacgacggcaagccccacaagcccaucuacaaggugcgcaucuacgagaagggguccggccgguucgcgcugggggagaagggccgcaaguacaagaaguacguccagggcgcccccaaccuguacuucgggaucuaccagggcgccaacaagcgcagcuucgccaccaucccgcucaacgaggugaucgagcggcagaagcaggggcgccccuccauccccgaguacaacgagaagggcgacccccugcuguucagccucuccccgaacgaccugguguacguccccguggagggggagaucaucgaggacaucgacuuccagaaccugagcaaggagcagaaggagcggaucuacaacgugaacgacuucuccagcacgugcuacuucacccccaaccgcaucgccaaggcgaucuuccccaaggaggucgaccuccagcggaagggcgacaagcugccgggcuccuacgacaccaagaccgccagccuggaggggauccagaucaaggaggugugcaucaagcucaagaucgaccgccugggcaacaucuccaaggccuga

SEQ ID NO: 2209 - RNA, 4317 nt, Artificial Sequence
  Cas9 variant
augaagaccauccugggccucgaccuggggaccaacagcaucggcugggcccugaucaagcagaacuucgagaacaaguacggggagauccucggcauggggucccgcaucauccccaugagccaggacauccugggcgaguucggcaaggggaacuccgugagccagacggccgcgcggaccgacuaccgcgccacccggcgccugcgggagcgcuuccuccugcggcgcgagcggcugcaccgcguccucaacgugcugaacuuccugccggagcacuacgccucccagaucgacuucgacaagcgguucggcaaguucaagguggagaccgagcccaagcucgccuggaagaacaucgacgggaaguucagcuuccuguuccagacguccuucaacgagaugcuggaggacuucaaggcccacggccaggaccucaagguccccuacgacuggaccaucuacuaccugcgcaagaaggcgcugagccagaagaucgagaaggaggagcucguguggauccugcugaacuucaaccagaagcggggguacuaccagcuccgcggcgaggaggaggaggagaaccccaacaagcugaucgaguucuacucccugaagaucaucgacgugcucgccgacgagccgcagaagggcaagagcgacaucugguacucccugguccuggagaacggguggaucuaccggcgcagcuccaagaccagccuccuggacuggaaggacaagauccgggacuucaucgugaccacggaccugaacgacgacggcuccgugaagaccgacaaggaggggaacgagaagcgcagcuuccgggcccccggcgagaacgacuggacccucgucaagaccaagacggagcaggagaucgaccgcucccggaagaccgugggcaacuacaucuacgagacccugcugcagaaccccaagcagaagaucaaggggaagcucgugcgcaccaucgagcgcaaguucuacaaggaggagcugaagcggauccuggagaagcagaaggaguuccaccgcgagcucgagagcaacgaccuguacaacgacugcauccgggagcuguaccgcaacaacgaggcccaccagcucacgcuguccaagaaggacuucguccaccuguucauggaggacaucaucuucuaccagcggccccucaagagccagaaguccagcaucagcaacugcacccuggaguuccgcaaguacaaggacgagaacggcaucgagcacacccaguuccugaaggcgaucccgaaguccaaccccuacuaccaggaguuccggaucuggcaguggaucuucaaccucaacaucuacaagaaggacaacgacgacaacgugaccaaggaguuccugaacacgacccgcgacuucgagaaccuguucgaguuccucaacaaccggaaggagaucgagcagaagccccugcugaaguuccugcucgagcagaaggaguucaaggggaagcugcugaacgccgagaccgagaaguuccgcuggaacuacguggaggacaagaaguaccccugcaacgagacccggacgaugaucagcgagcgccucaagaaggucgagaacaucuccgacgacuuccugacccgggagauggagcagaagaucuggcacaucaucuacagcgugaacgacaagaccgaguacgagaaggcccugaaguccuucgccgagaagaacaaccucgacgagaacagccuguucgaggccuucaagaagcugccgcccuucaaguccgaguacggcagcuucuccgagaaggcgaucaagaagcuccugccccugaugcgccucgggaaguacuggagcuacgccaagaucgaccuguacuccaagaaccggauccagaagaucaucaccggcgaguucgacgagaacaucaaggaccgcgugcgggagaaggccauccgccugacggccgagaacgacuuccagggccuccagcuguggcuggcccaguacaucgucuacgggcggcacagcgaggcguccaugaucggcaaguggaacagcgccgacgaccucgaggaguuccugaaggaguucaagcagcacucccugcgcaaccccaucguggagcaggucaucaccgagacccuccgcaucgugaaggacaucuggcugaaguacgggaacggcgccaaggacuucuucaacgagauccacaucgagcuggggcgggagaugaagcagaccaaggacgagcgcgccaacgccacgaagaccaucaccgagaacgagaacaccaaccuccggaucaaggcgcugcuggccgagaugaugaacgaccacagcguggagaacgugcgcccguacucccccaugcagcaggagauccucaagaucuacgaggacggcauccucaagagcgacaucgagaucgacgacgacauccugaagaucagcaagacggcccagcccuccagcuccgaccugaagcgguacaagcuguggcuggagcagaaguacaagagccccuacaccggccagaucaucccgcucaacaagcuguucacccccgaguacgagaucgagcacaucaucccccagucccgcuacuucgacgacagcuucuccaacaagaucaucugcgagagcgccgucaacaagcugaaggacaacuacaucgggcucggcuucaucaagcaguucgggggcaccaucaucgagugcggguucggcaagcgggugaaggucuucgaggugggcgaguacgaggaguucgugaagaagcacuacgccaacaaccgcgggaagcggaacaagcugcugcucgaggagauccccgagaagaugaucgagcgccagaugaacgacacccggcacaucuccaaguacaucagcggcauccugucccacaucguccgcguggaggacgggacggacgagggcgugaacagcaagaacgucaucccgggcaacgggaagaucaccacccagcugcggcaggacuggggccucaacgacguguggaacgagcugauccugccccgcuucgagcggaugaaccagcucaccaacuccacggacuucaccagcuggaacgagaaccaccagaaguaccugcccaccgugcccgucgaguucuccaagggguucagcaagaagcgcaucgaccaccggcaccacgcgcuggacgcccucgugaucgccugcgccaccaaggaccacgugaaccugcugaacaaccaguccgccaagagcgcgacgaagcgcuacgaccucaagaagaagcugaugaaguucgagaagaccgucuacaaggacccgcagaccgagaagcggaucgagcgcgaggugcccaagcacuuccugaagcccugggagaccuucacgguggacgccaagaaccggcucgagaccaucaucgucagcuucaagcagaaccugcgcgugaucaacaaggccaccaacuacuacgagaaguacguggagaaggacggcgucaugaugaaggagcgcguggagcagaccgggacgaacugggccauccggaagccgaugcacaaggagaccguguccggcaagaucgaccugcccugggucaaggugcccaagggcaagauccucaccgcgacccgcaagagccuggacacguccuucgaccugaaggccaucgccagcaucaccgacaccgggauccagaagauccucaagaacuaccuggaguucaaggagucccccgagcuggccuucagcccggagggcaucgaggacaugaacaagaacaucgagaaguacaacgggggccggccccaccagcccaucuccaaggugcgcgucuucgagcucgggagcaaguuccaggugggccagaccggcaacaagaaggacaaguacguggaggccgcgaaggggacgaaccuguucuucgccaucuacgaggacaagaagggcaagcgguccuacgagaccaucccccugaacgaggucaucgagcgccagaagcaggggcucagcgugguggaccugaagaacgucaacgacuucuuccugugcccgaacgaccucguguacauccccuccggcgacgaguucgagaaccgggggagcaucgagaucgagaacaucaccaaggagaaguccgagcgcuucuacaagguggucagcuucuccggcagccagaucuucuucgugcggcacgacaucgccguguccaucgucaacaagggcgaguucagcacccugaacaagauggagcgcgccaucgacggguccauggugaaggagaucugcaucaagcugaagaucgaccggcucggcgacgugcugaaggccuga

SEQ ID NO: 2210 - RNA, 4317 nt, Artificial Sequence
  Cas9 variant
auggugaagaagggcuacaccaucgggcuggacaucggcaccacgagcgucgggugggccgugaccgacgacgacuucgagcucgugaacaagaagauguccaucaaggacaagagcggcuccaccaucaagcgcguccggaagaaccuguggggcgugcgccuguucgacgaggccaagaccgcggagaacacgcggcgcacccgcggggugcggcggcgcauccggcgccggaaggagcgccucaacuaccugcagggcaucuucagcuccgagauggccaagauggacgagaacuucuucaugcggcuggaggagagcuucuucaagcucuccgacaagagcgagcagaacaaguuccccuacgcccuguucaagaacgagaucgaggagaaggccuacuaccgccaguucccgaccaucuaccaccuccggaagcaccucauggagcacgaggaguccgaccugcgcaagaucuaccuggggcuccaccacauccugaaguaccggggccacuucguccaggaggggcagaagauggacguggccaacaucgacauccagggcaaccugaaggagcuguucaacgcgcugaacgagaacuucagcaacaaggaggacgacuucgagcaggagcgcaugaaggacggggugaagcgggccaagguccuguucgacaccgagaagcucgccgccguggaggagauccugaaggagaagaucuccaagagcuggaaggugaacaagaucuccaagggcauccuggcggagaagaaggaccuccccaucuucaaggccaucgucggcaacaagaucgaccuggccgggaucuucgacugccccgacuacgccgagaaggugaacgagagcaucaaggagcugaaggacaagguguacuucaacaaggaggacuucgaggagacguucgagaagcucucccagcugcugaaggaggaggagcucgagauccugauccuggcccgcaagugcuacgaggcgguccuccuggccgacaucaugcagggcgagcagagccuguccgacgccaugguggccaaguacaacgaccacaagaaggaccucgugaucuucaagaaguucgucaucgacuacuucagcgaggacguguacuucgaccuguucaagaacacccagcuggccgggaacuaccacuccuacgugaagggcgagcggaagggcaacaaguucaaccacgcgagccucgacgacuucuacaaguucgucaagaaggagcuggacaagaaggccgaggagcugagcgagcaccccguguacaagcagauccuccagaagaucgagcuggagaccuuccugccgaagcagcgcauguucaagaacggggccauccccuaccaggugcaccuccacgagcugcgcgccaucaucaagaagcaggagaagcgguuccccuuccuggccgagaagaucaucaucaaggacaaccagaaggacaucuccgaguacaagaucgagacccucaugaaguuccgcauccccuacuacgucggcccgcugaucgaggcgcgggagggggagcugggcaagaagcgcacgaacuacagccgguucgccuggaugcagaagucccccgagagccagaacaucgggaucacccccuggaacuuccacuccguggucgacaaggacgccagcgccuccgaguucaucgagcgcaugaccggcuucugcagcuacuuccccgaggagccggugcuccccaagaacucccugaucuaccagcaguucaccguguuccaggagcugagcaucgucggcuacuacgacgagcagaaccggaagcacuaccuggacggggagacgcgccggcgcaucuucgaggaccucuucaagaagaaccggaccguguccgccggccugcugcgcaaguggcucgugugcaaccagcggaccagccaggaggagaaggagauccgccuguucgggcuggaccucaagaagaacggccugggguccggcaacuucaacaccaaguacacgaccuaccuggaccucaaggacgcgggcaucaccgagaagcagcugaagcagcacaaggacuucuucgagaagaucgucaaguaccagaccaucuucgaggacaagaagauccugaagcggcgcaucauccuccugaacgaggagcagccccugcucagcgaggagcagaucaagaaccuggccaagaagcacuacacgggguggggcaaccugucccucaagcugaucgacgggauccaggacaagggcaagaccauccuggacuaccucgagacccaggacuacaaccagaaccugaugcagcugaugaacgacgagaacaagagcuucgagaugcagaucgagcaggcccgggccgggaaggugcaguucggcaagaucgacuacuccuucguggagcagcucgcgggcagccccgccaucaagcgcgggaucuggcagucccugcagaucgucgaggagcugguggccuuccucggcaaggagaacaucaagaagaucgugaucgagauggcccgggagaaccagagcagcaagcgcaccaagucccgccagaagcagaucgaggcccuguaccagaaggucacgggggaccugaagaacgagcaggagaagaucgacgugaugcagaacuucgacaacgagcggguguuccucuacuaccugcagaacggcaagugcaugcacagcggcgagaagcuggagcucucccagcugagcgaguacgagaucgaccacaucaucccgcagaccuacaucaaggacgacuccuucgacaacaagguccuggugacccgcaacgcgaaccagcagaagggcggggacgugcccagcuacgacgucaucgacaagaugaaguccuacugggagaagcucaaggagaacaaccugaucagcgagaagaaguucgccaaccugaccaaggggaaguucgacgaccagcagcucuccggcuucaucaaccggcagcugguggagacgcgccagaucaccaagaacguggccaucauccuggacaagaucuacaacgacgaggccaagaacgagaaggaggucgccaucaucacccucaagagcgcgcugaccucccaguaccggcaggggaucaucuacgugcccaacgacgacuucgacgagcugaagcucgugagcaagacgaacucccgccugaaggaggucaagcugcacgacggcuucuacaaggugcgggagaucaacgacuaccaccacgcccacgacgccuaccucaacaacguggucgccaccuaccuguacgaggccaugcccgaccugcgcccccucuucguguacggcgagcacagccgggagauccacaagcgcuuccuggggaaguacgcgaccacccggaagggccaguucaagcagcugcucguggacaugcaggacgaguacuggaugcgcaaggacaaggaggggaacuucaucgacggcgagauccuguggcggcgcgacgagguccugcagaucgugaagaaggugcucgacuaccggaacauccagaucaccaagaagcuggagaugauggucaccgggggcgaggagaaguccuucuaccaggacagccgcugccggaaggacaagacggccaucccguacaagaccaacugggaccccuccaaguacggcggguucaagagcccccgcaccgccuacgccaucccggugaucaagaagaacaagcccaagcuggagcccgugcuccuggucaaccggagcaagguggagacggacggccaguucgacugcgagaaguucaaggagcugaaccccacccucaagauccuggggcagccgaucuggaaguaccaguccuucgagauguucgacggcaccaagcgcuacaucgcgagcgccuccgagauccacaaggggaaccagaucaaguucagccaggagcacaugaaguucaucuccugcugccagaaguacgacgaggugaagaacaagcuggccuucgacuucgucaacgagagcaagcaccucuuccaggagauccugaccgccaucaaggacaacauccaccgguaccgccugaucgccgagggcaucgaggugcaccgcaaguucuccaacaugcucgagaacaucgagaagcugagcacgcaggagcugguggacaaccuccuggacgcgaucaacaucaccuccgucggcaccaccaacaacgccuucgggcgggugcgcuacaagggcagcuaccugaacgagaucugguccgccacgcucauccaccagagcgugaccgggcuguacgagacccgggagaagcugaucuga

SEQ ID NO: 2211 - RNA, 4323 nt, Artificial Sequence
  Cas9 variant
augaagaccauccugggccucgaccuggggaccaacagcaucggcugggcccugguggagcaggacuucgagaacaagcaggggcucauccugggcauggggucccgcaucauccccauggacgccggcaucaucggcaaguucgcggaggggagcuccaucagccagacggccgagcggaccggcuaccgcuccauccggcgccugcgggagcgccaccuccugcggcgcgagcggcugcaccgcguccucaacauccugaaguuccugccggagcacuacgccgccgagaucgacuucgagaagcgguucgggcaguuccucgccgagaccgagcccaagcuggcguggaagaaguccgccgagggcaaguucgaguuccuguuccagcgcagcuucgacgagaugguggccgacuucaaggccaacgggcaggacaucaagauccccuacgacuggaccaucuacuaccuccggaagaaggcgcugacgcagaagaucagcccccaggagcuggccuggaucauccucaacuucaaccagaagcgcggcuacuaccagcugcggggcgaggaggaggaggagaacccgaacaagaagguggaguucuacucccugaagaucgucgacgugguggccgacgagcagcccaacaagaagggggacaccugguacagccuccaccuggagaacggcugggucuaccgccgguccagcaagaucccccuguacgacuggaaggacaaggugcgcgacuucaucgugaccaccgacaucaacgaggacggguccgagaagcucgacaaggacggcgaggucaagcggagcuuccgcgcccccaaggaggacgacuggacgcugaucaagaagaagaccgagcaggagaucgagcaguucaaccagaccgugggcuccuacaucuacgaggcccugcucgacaacccgacccagaagauccgggggaagcuggugcgcacgaucgagcgcaaguucuacaagagcgagcugaagaagauccucgagaagcagaucgagcugcagcccgagcuguucaccgaggaccucuacaacgcgugcgcccgggagcuguaccgcuccaacgucgcccaccagcagcagcugagcucccgggacuucguguaccucuuccugaacgacaucaucuucuaccagcgcccccugcggagccagaagucccucaucagcaacugcagccuggaguuccgcaccaucaaggacaaggacggcaacgggcagaucaucuaccugaaggccauccccaaguccaacccguacuaccaggaguuccggguguggcaguggcucuacaaccugaagaucuucaccaaggaggacgacaaggacgucacgaaccaguucaucaacaagguggaggaccuggaggcccucuucgaguuccugaugaaccagaaggaggugaaccacaccgacauccugaccuaccucaucgagcccaucgucaagagcaaguaccccaacgcgaagggcaaggccuucaaggacgagcugaagaaggagcugaagaaguaccgcuggaacuacguguacgacgccgacaaggacgaguccaagagcuaccccaugaacgagacccgguacgagcugcgcaagcggcucgacaagguggagaacgucccggccgacuucaugacgcgcaagaucgagcagcaccuguggcacaucaucuacuccgugaccgacaagaucgaguucgagaaggcccucaagagcuucgcgaacaaguacgaccugcaccaggaguccuucguggagaacuucaagcgguucaagcccuucgacagcgacuacgggaccuacuccgagaaggccaucaagaagcugcugccccucaugcgcgucggcaaguacuggagcugggagggcaucgacaacaacaccaagaagcggaucgggaagaucaucacgggcgaguacgacgagaccaucaagaaccgcgugcgggagaaggccaucgaccugaccgaggagaaccacuuccaggggcugcagcucuggcuggcccaguacaucgucuacgaccgccacuccgaggccgacaucgcgggcaaguggaacagcguggccgaccuggagcaguaccucuccgaguucaagcagcacagccugcggaaccccaucguggagcaggucaucaccgagacgcugcgcguggugcgcgacaucuggaagcaguacgggaagggcgccaaggacuacuucgacgagauccacaucgagcucggccgggagaugaagaacaccgccgaggagcgcaagcggcuguccagcaucaucuccgagaacgagaccaccaaccugcgcauccgggcgauccucgaggagcugauguacgacgagaacauggagaacguccgcccguacagccccaugcagcaggaggcccugaagaucuacgaggacggggugcucagcuccagcguggagauccccgaggacaucgagaagaucuccaagaaguccgagcccaccaagagcgagauccagcgguacaagcuguggcuggagcagaaguaccgcagcccguacacgggccggcccaucccccucuccaagcuguucacccccgccuaccagaucgagcacaucaucccgcaggcccgcuucuucgacgacggguucagcaacaaggucaucugcgaguccgaggugaacgcccugaaggacaagaugcucggccuggaguucauccagaacuacuacgggcagaaggugaccacgagcuucggcgaggucaccauccugaccgaggacgcguacaaggccuucgugaaggagcacuacgacaagaaccgguccaagcgcaacaagcuccugcuggaggagauccccgagaagaugaucgaccggcagaugaacgacacccgcuacaucagcaaguacaucuccaaggugcucagcaaccugguccggggcgagaaggacgacgagggggugaacuccaagaacaucauccccggcaacgggaagaucagcggcacccugaagcaggacuggggccucaacgacguguggaacgaccugauccugccgcgcuucgagcggaugaaccagcucacgaacuccaccgacuucaccgccuggaacgagaagcaccagaaguuccugcccaccaucccccuggagcucagcaagggguuccagaagaagcgcaucgaccaccggcaccacgcccuggacgcccugaucaucgcgugcgccacgcgcgaccacgucaaccuccugaacaacaagcacgccaagagccggaacgagcgcuacgaccugcagcacaagcuccgccacaccacccccuggcaggacaaggagggcaaggugcggaccaaguucacggaguucaagaagccgugggagaccuucacccaggacaccaagaaggagcuggagaagaucguggucuccuucaagcagaaccugcgcgugaucaacaaggccacgaacuacuacgagaagaucguggacgggaagaaggucauguucaagcaggagggcgugaacugggccauccggaagcccaugcacaaggagaccgugagcgggaagaucgaccucccccgcgucaagguguccaagggcaagauccugaccgcgacccgcaagagccuggacacguccuucaacgccaagaccauccucagcaucaccgacaccggcauccagaagauccugcugaacuaccucaaggccaaggggaaccccgagcuggccuucuccccggagggcaucgaggagaugaaccagaacaucagccuguacaacgacgggaagccccaccagcccauccucaaggugcgggucuucgagcagggcuccaaguucccccugggggagacgggcaacaagaccaccaaguacguggaggcggccaagggcaccaaccuguucuucgggguguacgagaacaaccagggcaagcggagcuacaacacgaucccgcucaaccuggucaucgagcgccagaagcaggggcugaacuccgugcccgagaccaacgagaagggccaccggcuccuguucagccugucccccaacgaccucguguacguccccaucgagggggagguguucgacaagaccaacccggacgugaaccgcaucuacaagaucgucagcuucuccggcagccagauguucugcgugcggcaggacguggccaccuccaucgucuacaagcuggaguucagcucccugaacaagauggagcgcacgaucgacggcaucaugaucaaggagaucugcaucaagcucaagguggaccggcuggggaacaucagcaaggccuga

SEQ ID NO: 2212 - RNA, 4323 nt, Artificial Sequence
  Cas9 variant
augaagaccauccugggccucgaccuggggaccaacagcaucggcugggcccugguggagcaggacuucgagaacaagcaggggcucauccugggcauggggucccgcaucauccccauggacgccggcaucaucggcaaguucgcggaggggagcuccaucagccagacggccgagcggaccggcuaccgcuccauccggcgccugcgggagcgccaccuccugcggcgcgagcggcugcaccgcguccucaacauccugaaguuccugccggagcacuacgccgccgagaucgacuucgagaagcgguucgggcaguuccucgccgagaccgagcccaagcuggcguggaagaagaacgccgagggcaaguucgaguuccuguuccagcgcagcuucgacgagaugguggccgacuucaaggccaacgggcaggacaucaagauccccuacgacuggaccaucuacuaccuccggaagaaggcgcugacgcagaagaucagcccccaggagcuggccuggaucauccucaacuucaaccagaagcgcggcuacuaccagcugcggggcgaggaggaggaggagaacccgaacaagaagguggaguucuacagccugaagaucgucgacgugguggccgacgagcagcccaacaagaagggggacaccugguacucccuccaccuggagaacggcugggucuaccgccggagcuccaagaucccccuguacgacuggaaggacaaggugcgcgacuucaucgugaccaccgacaucaacgaggacgggagcgagaagcucgacaaggacggcgaggucaagcgguccuuccgcgcccccaaggaggacgacuggacgcugaucaagaagaagaccgagcaggagaucgagcaguucaaccagaccgugggcagcuacaucuacgaggcccugcucgacaacccgacccagaagauccgggggaagcuggugcgcacgaucgagcgcaaguucuacaaguccgagcugaagaagauccucgagaagcagaucgagcugcagcccgagcuguucaccgaggaccucuacaacgcgugcgcccgggagcuguaccgccggaacgucgcccaccagcagcagcugagcucccgcgacuucguguaccucuuccugaacgacaucaucuucuaccagcggccccugcgcagccagaagucccucaucagcaacugcagccuggaguuccggaccaucaaggacaaggacggcaacgggcagaucaucuaccugaaggccauccccaaguccaacccguacuaccaggaguuccgcguguggcaguggcucuacaaccugaagaucuucaccaaggaggacgacaaggacgucacgaaccaguucaucaacaagguggaggaccuggaggcccucuucgaguuccugaugaaccagaaggaggugaaccacaccgacauccugaccuaccucaucgagcccaucgucaagagcaaguaccccaacgcgaagggcaaggccuucaaggacgagcugaagaaggagcugaagaaguaccgguggaacuacguguacgacgccgacaaggacgaguccaagagcuaccccaugaacgagacccgcuacgagcugcggaagcgccucgacaagguggagaacgucccggccgacuucaugacgcggaagaucgagcagcaccuguggcacaucaucuacuccgugaccgacaagaucgaguucgagaaggcccucaagagcuucgcgaacaaguacgaccuccaccaggaguccuucguggagaacuucaagcgcuucaagcccuucgacagcgacuacgggaccuacuccgagaaggccaucaagaagcugcugccccucaugcgggucggcaaguacuggagcugggacaucaucgacgacaagaccaagacgcgcaucggcaagaucaucaccggggaguacgacgagaccaucaagaaccgggugcgcgagaaggccaucgaccugaccgaggagaaccacuuccagggccugcagcucuggcuggcccaguacaucgucuacgaccggcacuccgaggccgacaucgcggggaaguggaacagcguggccgaccuggagcaguaccucuccgaguucaagcagcacagccugcgcaaccccaucguggagcaggucaucacggagacccugcgcguggugcgggacaucuggaagcaguacggcaagggggccaaggacuacuucgacgagauccacaucgagcucggccgcgagaugaagaacaccgccgaggagcggaagcgccuguccagcaucaucuccgagaacgagaccacgaaccugcggauccgcgcgauccucgaggagcugauguacgacgagaacauggagaacguccggccguacagccccaugcagcaggaggcccugaagaucuacgaggacggcgugcucuccagcagcguggagauccccgaggacaucgagaagaucuccaagaaguccgagcccaccaaguccgagauccagcgcuacaagcuguggcuggagcagaaguaccggagcccguacaccgggcgccccaucccccucuccaagcuguucacccccgccuaccagaucgagcacaucaucccgcaggcccgguucuucgacgacggcuucagcaacaaggucaucugcgaguccgaggugaacgcccugaaggacaagaugcucgggcuggaguucauccagaacuacuacggccagaaggugacgaccagcuucggggaggucaccauccugaccgaggacgcguacaaggccuucgugaaggagcacuacgacaagaaccgcuccaagcggaacaagcuccugcuggaggagauccccgagaagaugaucgaccgccagaugaacgacacccgguacaucagcaaguacaucuccaaggugcucagcaaccugguccgcggcgagaaggacgacgagggcgugaacuccaagaacaucauccccgggaacggcaagaucacggggauccugaagcaggacuggggccucaacgacguguggaacgaccugauccugccgcgguucgagcgcaugaaccagcucaccaacagcaccgacuucaccgccuggaacgagaagcaccagaaguuccugcccuccgucccccuggagcucagcaagggcuuccagaagaagcggaucgaccaccgccaccacgcccuggacgcccugaucaucgcgugcgccacgcgggaccacgugaaccuccugaacaacaagcacgccaagucccgcaacgagcgcuacgaccugcagcacaagcuccggcacaccacccccuggcaggacaaggaggggaaggugcgcaccaaguucacggaguucaagaagccgugggagaccuucacccaggacaccaagaaggagcuggagaagaucgucgugaacuucaagcagaaccugcgggugaucaacaaggccacgaacuacuacgagaagaucgucgacggcaagaaggugauguucaagcaggagggggugaacugggccauccgcaagcccaugcacaaggagaccgucagcggcaagaucgaccucccccgggugaaggugagcaaggggaagauccugaccgcgacccgcaagucccuggacacgagcuucaacgccaagaccauccucuccaucaccgacaccggcauccagaagauccugcugaacuaccucaaggccaagggcaaccccgagcuggccuucagcccggaggggaucgaggagaugaaccagaacaucucccuguacaacgacggcaagccccaccagcccauccucaagguccggguguucgagcaggggagcaaguucccccugggcgagacggggaacaagaccaccaaguacguggaggcggccaagggcaccaaccuguucuucggcgucuacgaggacaaccaggggaagcgcuccuacgacacgaucccgcucaacaucgugaucgagcggcagaagcagggccugaacagcgugcccgagaccaacgagaaggggcaccgccugcuguucucccugagccccaacgaccuggucuacgugcccaucgagggcgagguguucgacgagaccaacccggacgucaaccggaucuacaaggugguguccuucagcgggucccagauguucugcguccgccaggacguggccaccagcaucguguacaagcucgaguucuccagccugaacaagauggagcggacgaucgacggcaucaugaucaaggagaucugcaucaagcugaaggucgaccgccucggcaacaucuccaaggccuga

SEQ ID NO: 2213 - RNA, 4332 nt, Artificial Sequence
  Cas9 variant
augaucaagcugcucuaccuggagaagcugaagcaguacaccaugaagaagauccucggccuggaccuggggaccagcuccaucggcugggcccucgugaacgaggccgagaacagcgacgaggucuccagcaucaucaagcugggggugcgcgugaacccccugacggucgacgagaugcagaacuucgagaagggcaaguccaucaccaccaacgcggaccggacccucaagcgcagcaugcggcgcaaccugcagcgguacaagcugcgccgggacgcccucaucgagcugcugaagaaggugggguucaucacggacaagaccauccucuccgagcagggcaaccgcaccaccuucgagacguaccggcugcgcgccaaggccgccgaggaggagaucagccugaaggagcucgcgcgggugcugcugaugaucaacaagaagcgcggcuacaaguccagccggaaggccaagggggaggaggagggcgcccucaucgacgggauggagaucgccaagaagcuguacgacgaggaccugaccccgggccagcucugccugcagcugcucgaguccgggaagaaguucuuccccgacuucuaccgcagcgaccugcaggaggaguucaacaagaucugggacuuccagaagcaguucaaccuguucuccuucugcgacgucgcgaaggaggaggugaagggcaagaacaagagccagaccugggccauccucgccaaguacuucguggagaccaagaaggucaacguguggaacgagcacgaggcccagacggagaaccgggaggagguguacaagcuggucggccugaagcgcaccgugaagggggaggagcucaagaaggagaacuaccgguggcgcgugcaggcccugaccgagcagcuggaccucgagaagaucgcggucgugcugcaggagaucaacggccagaucuccgccagcuccggguaccugggcgccaucagcgaccgguccaaggugcucuacuucaaccgccagaccgucggccaguaccagauggccgagcugaacaagaaccccaacaugagccugcggaacaugguguucuaccgccaggacuaccucgacgaguucaacgugaucugggagaagcaggccgaguuccacaaggagcugacgcccgagcugaagaaggagauccgcgacaucaucaucuucuaccagcggcgccucaagagccagaaggggcugaucuccuucugcgaguucgagaaccgggaggucgugguggagaaggagggcaagaagcagaccaagaucaucgggugcaaggucaucccgcgcagccacccccuguuccaggaguucaagaucuggcagacccucaacaacaucgagguguucgucggcgagaagaaggggaagcggaagaaguccaacgugagcuccgaccuguucggcgacaccgaggacgcgcugaucacggagggccgccgguuccuguaccaggaggagaagaagauccucgccaaggagcugagcaucaagaaggggcugaccaaggccgagauccuccgccugcuguucgagaacccccaggagcucgacaucaacuucaagcagaucgacggcaaccagaccggguucgcccuguucuccgccuacagcaacaugaucgagaaguacggcuacgagccccuggacuucaagaagccggcggaggaccucaucucccagcugaagaccguguucacggaccugggguggaacaccgaccuccuguucaucgaccuggacaaggagaacaaggagugggagaagcagcccuacuuccggcucuggcaccuccuguacagcuucgagggcgacaacacccccaccggcaacgggaagcucaucgagaagaucaugcagcugugcggcaucgagaaggaguacgccaucgagcuggccaacgucucccuccaggacgacuacgggagccuguccgccaaggccaucaagaagauccugcucuaccugaaggagggcaaccaguacgacauggcgugcgaguacgccggguaccgccacagcaaguccagccugacgaaggaggagaucgagaacaaggugcucaaggacaagcuggagauccugcccaagaacucccuccggaacccgguggucgagaagauccugaaccagauggugaacgugaucaacaccgucauggagguguacggccgccccgacgagauccggguggagcuggcccgcgagcucaagaaguccgccaaggagcgggaggagcugaccaaggcggucgccaagaacacccgcgagcacgaggagauccggaaggugcugcagagcgaguucggcaugaucaacgugagccgcaacgacaucauccgguacaagcucuacgaggagcugaaggacaacggguacaagacgcuguacagcaaccaguacaucccccgcgagaagcuguucuccaaggagaucgacaucgagcacaucaucccccagagccgccuguucgacgacucccugagcaacaagacccucgaguacaaguccaucaacaucgagaagggcaacaagaccgccuacgacuucgucaaggagaaguacggggaggagggccugcagcaguaccugaaccggugcgagaaccucugcaaggacaagaaggccaagcugcgcaagcugaagauggagcucaacgagaucccggacggcuucaucgaccgggaccugcgcaacacccaguacaucgccaagaaggcgcugagcaugcucacggagaucugccggcgcgugguggccaccaccggguccaucaccgacaagcugcgggaggacuggcagcuggucgacgugaugaaggagcucaaccugcccaaguacgaggcccugggccucguggaggucuacgaggacaaggacgggcgcaagaucaagcggaucaaggacuggaccaagcgcaacgaccaccggcaccacgccauggacgcccugacgguggcguucaccaaggacguguucauccaguacuucaacaacaagaacgccgccugggagagcgacuccaaggagcacaccaacaucgucggcaucaagacccgcuacuucgagagcgggaaggccgugccgcccaucccccugggccaguuccggguggaggccaagugccaccucgagaaccugcuggucuccaucaaggcgaagaacaagguggugacgaccaacgucaacugcaucaagaagaagggcgggaccuacaagaacacccagcagacgccccgcggccagcuccaccuggagaccaucuacgggagccacaaccaguacgugaccaagaucgagaaggugaacgccuccuucgacgccgucaagaucgccaccgugagcaagcaggacuaccggaacgcgcugcucaagcgccuggagguguucggcaacgaccccaagaaggccuucacggggaagaacucccuggagaagaaccccaucuaccucgaccgggcccagaccauccaggucccggacaaggugcagaccguggagcuggagaccgccuacacgauccgcaagcccgucgaccccacccugaacguggacaagguggucgacaagaagauccggcucauccuggagcagcgccugaaggaguacggcggcgacgccaagaaggcguucgugaaccucgacgagaaccccaucuggcugaacgaggagaaggggaucagcaucaagcgggugaccauccgcggcaucuccaaggcccaggcccugcacgacaagaaggacaaggacgggaacuucauccucgacgagaccggcaagcgcaucccggucgacuucgugaacacggggaacaaccaccacguggccaucuaccggaagcccguccuggacaagaagggccaggugaucuucgacgacgagggcaaccccauguacgagcuggacgaggacguggucccguucuucgaggccgugacccgcgcgaaccucgggauccccaucaucgacaaggacuacaagaaguccgagggcuggcaguuccuguucagcaugaagcagaacgaguacuucgucuuccccaacgagaagaccggguucaaccccaaggagguggaccugcucgacccggacaacuacgccaugaucagccccaaccuguuccgggugcagaagaucggccugaacgacuacaccuuccgccaccaccucgagacgaccauccagaacgaccugaaguucaucaccuggauccggugcggcaagagcgggaucaaggacaucgucaaggugcgcaucaaccacaucggccagaucguguccgucggggaguacuga

SEQ ID NO: 2214 - RNA, 4332 nt, Artificial Sequence
  Cas9 variant
augaagaagauccugggccucgaccuggggaccgccagcaucggcuccgccuacgugcuggaggcggagaaguccgccgaccagaccaagaucgucuaccucgggacgcgcaucauccuguccagcgccgacgccgagaacuucuccaagggccugagcugcucccccaccaccgaccggaccuucaagcgcagcaugcggcgccggcuccagcgcuacaagcagcggcgcuccagccugauccagcaguucaagaagaucgggaucaucacgaacaccgagcagaucauccgggagccgaucuccgagacccacgagcugcuccgcauccggagcaaggccguguccgagcacgugagccuggaggaguucgcgcgcauccugcucaccaucaacaagcggcgcggcuacaaguccaaccggaagacgagcaaguccaccgaggaggacggcaagcuggucgacgccauggccgugaccaaggagcugaucaagcucaagaagacccccgggcaguacauguucgagcgcuucaagcggggcaaguacgccgagaucgacuucuaccccuucgaccugaucaacgagcugaagcagaucugggaggugcaggggcagaaguaccccgacguccucacggagggccugcugagcucccuccugaagcagaagaccgggaaggcgaaggagcugaucuacagcaagagcgaccucaacccggccgaggugcccaucgacuaccagaagggcaagaagcugcgcaagaccauccugaacaaguacuucgccuacgagucccggagccucgccgugaccaacaucauccccgucgagcaggccaucacggcgaucguggccaucugcaagcagaucaacaacuccagcggcuaccugggggccaucggcgaccgcucccgggugcuguacgccaacaaccagaccaucgggcaguaccucuacgagcgcaucaaggccaacccccacgaccgcauccggggcgaggucuucuaccgccaggacuaccuggacgaguucgaccggaucugggagugccagcagaacuacuacccggcgauccugaccaacgaccgcaagcaguacauccggaaccgcaucaucuucuaccagcggccccucaagagcaagaaguccgagcuggccuucugcgaguucgagagccgcgagguggagcacaacggcaagaaguacaccgaggggcugcacguggcccccaaguccagccccgucuuccagcacuuccggcucuggcagcgccugggccagaucgagguguccccgcugcggaagugggacaagcagagcaacgagcuguucgagcagcagaacaacgccgaccgcgaggggauccucaacacggaggccaagcagaagcuguucuccuaccucaaccugcuggaccaccucaccgacaacgagauccugaacauccugggcuacagccccgacaaguggaagaucaacuuccgggagaucaucgggaaccgcaccaacaaccucaugaugaaggcguucuucuccaugaaggagaugaccgacggcgagcagaucgacugggagaagaaccugacgaagaucaccaacggccagagccugaucucccccgagcagaucguggaccugauccggcaguucuucgagcgcgaggggaucaccaccagccuccuguacuucgaccccgccacggacaacuuccgggagcagucccacuacagccuguggcaccuccuguacagcuacgaggacgacaacuccccgaccggcaccaccagccugugcaagacgcucgccaagcgcuacgggaucccccacgagcugugcccccugcucgccucccugaccuucgagcggcaguacggcagccuguccaccaaggccaugcgcaagcuccugcccuucaugcaggagaagcgcuacgacgaggcgugcgagcuggccggguaccggcacagcgccuggaucaccaaggaggagaacgccaagcgcacgcucaagaacaagcugccgcugcuccggaagggcucccugcgcaaccccgucguggagaagauccugaaccagaugacccacgugaucaacacccacaucgcggaguacggcaaccccgacgagauccggaucgagauggcccgcgacaugcaggccaacagcaagcagcggaaggccaugaccgccgcgaucaccgaggccacgaagcgcaacacccaguucaucgaggagauccagaaggaguucggguucaaccccuccaagaacgaccucaucaaguacaagcuguggaaggagcuggccccgcucggcaacaagacccuguacagcaacaucuacauccccaaggaggagcuguucaccgccaaguucgagaucgagcacaucaucccccgggcccucuucuacgacgacuccuucagcaacaagacgcuggagcugaacuccgucaacaagcucaaggggaacaagaccgcgcuggacuaccuggacacccucggccaggagaaggccaacgacuacauccugcgcguggaggagcugaagaagaucggggccaucacccaggccaaguacaagaagcuccugauccgggagaaggaccugggcgacgacuucacgaaccgcgaccucaccaacacccgguacaucauccgccacgccgcggaccgggaccugaccaacacgcgcuacaucauccggcacgccgccgacaugcugcuccaggugacccccagcaucguccacaccaacggcuccaucaccgccauccugcgccgggacugggggcugcucgacauccugaaggagcugaaccucccgacguacgagagcaucgaccgcaagaucuccgaccccgaggagaagcugacccagagcguggaccggaaggacggccaggcgaucaagaugaucaaggacuggagcaagcgcgacgaccaccgccaccacgccauggacgcccugaucaccgcccucaccacgcggaagcacguccaguaccugaacgggaacuccggcgccgaggagaccgacaaggcgcagaagcuggagcagcucaaggcccugcgcaagcagcugaucggcagcgacgggcacuucaucccgcccaugcacgacauccgggugcaggccaaggaggcccucucccgcgugaucaucagcaccaaggucaagggcaaggugaccacgcccaacaccaacaucaucugcucccgggacaagaccaccgggcgcaagaucuacgugcggcagacgacccugacgccccgcggcgcccugcaccucgacaccaaguacgggaucaaccgguacuaccaggagcgcgaggucagcaucggcuccaagcugacccaggaggagauccggcuggugagcagcccccacauccagagcauccuccuggagcgccugcgggcguucgacaacaacccgaaguccgccuucaccggccgcaacagcguggacaagaagccccucgaggacaagaacaagaagcuggucuacaccgacaagaaggugaagcagaccauccuggccaaccgguucgugaagcgcgaccgggucaacuccaagcucgaccuggacaacgugaucgacacggggaucaagcgcauccuggagcggcgccucaagcaguacggcgggaaguacgagaccgccuucagcgaccuggagaacaaccccaucuggcugaacgaggagaagggcaucgccaucaaguccgugcgcauccgggggaagaacaacaccaucaccauccgccagaccaacacgugccggaucaaguacgucgcgaacgacaacaaccaccaccucgccguguacgcccugcccgacggcagcaucaaggacgacaucguguccuucuucgacgccgucgagcgcagccggaagcgccugccgaucaucgacaagcacaagaaccagucccucggcuggaaguaccuguucagcaucaagcagaacgaguacuuccugcucccccagcaggucgagaagaucgacaucgacaccggggagaucagcaugcagaccaccuucucccccaaggaccugagccacgaguacaucaugaaccccgacaacuacgcggagcuggccucccacaucuuccgggugcagagcaucuccaagacgccgcagggcaaccgcgacgugcggaucuaccucuucaagcagcaguacaucagcgggucccagaaggacagccugcaccugaagggcaucacccaccgccagaucuccagcgccaaggaccucgccgagcuggugaagauccgggugaaccaccuggggcgcaucgucuccgugggcgagaaguga

SEQ ID NO: 2215 - RNA, 4341 nt, Artificial Sequence
  Cas9 variant
auggugaagaacauccugggccucgaccuggggaccaacagcgucggcugggcccugaucaagcaggacuucgagaacaagcagggggacauccucggcauggggucccgcaucauccccaugagccaggacgugcugggcgacuucggcaaggggaacuccaucagccagaccgccgagcggacgaaguaccgcuccgugcggcgccugcgggagcgcuuccuccugcggcgcgagcggcugcaccgcguccucaacgugcuggacuuccugccggagcacuacgcgagccagaucgacuucaacaagcgguucggcaaguucaaggaggagaccgagcccaagcucgccuacuccaacgacggguucaucuucaagaaguccuucgaggagaugaucagcgacuucaagacccaccagcccgagcugcuggagaacaacaagaaggugcccuacgacuggaccaucuacuaccuccgcaacaaggcccugagccacaagaucgagaaggaggagcuggccuggauccuccugaacuucaaccagaagcggggcuacuaccagcugcgcggggaggaggaggaggagaacccgaacaagcucaucgaguucuacucccugaagaucgucgacgugcuggccgacgagccccagaagggcaagagcgacaucugguacucccucauccuggagaacggcuggaucuaccggcgcagcuccaagaucccccugcucgacuggaaggggaagacgcgggacuucaucgugaccaccgaccugaacgacgacggcagcgucaagaccgacaaggaggggaacgagaagcgcuccuuccgggcgcccggcgagaacgacuggacgcuggugaagaagaagaccgagcaggagaucgacaacagcgacaagaccgugggcgccuacaucuacgaggcccuccugcagaacccgaagcagaagaucaaggggaagcugguccgcaccaucgagcggaaguucuacaaggccgagcucaagcagauccuggagaagcagauggaguuccaccccgagcugcgccaggacgaccucuacuccgacugcgugcgcgagcuguacaagaacaacgaggcgcaccagcugacgcucagcaagaaggacuucgugcaccuguucauggaggacaucaucuucuaccagcggccccugcgcagccagaaguccagcaucuccaacugcacccucgaguuccggaaguacaaggacgagaacggcaccgagcacauccaguaccugaaggcccugcccaagagcaacccguacuaccaggaguuccgcaucuggcaguggauguacaaccucaacaucuacaagaaggaggacgacaccaacgucacgaaggaguuccugaacuccaaggccgacuucgagagccuguucgaguuccucaacaacaagaaggagguggaccagaaggcccugcugaagcacuucaagaucaacgacaagacccaccgguggaaguacguggaggacaagaaguaccccugcaacgagaccaagaccaugaucuccgagcgccugaagaaggucgagaacaucagcgacgacuuccucacgcgggagauggagcagaagaucuggcacaucaucuacuccgugaacgacaaggugaaguacgagaaggcccucaagagcuucgcggagaagaacaaccuggacgaguccagcuucuucgaggccuucaagaaguucccgcccuucaaguccgaguacggggccuucagcgagaaggccaucaagaagcuccugccccugaugcgccucggcaaguacugggacgacgacgagauccugaaguacuccgacaucuacuucaagaacaucgaguaccugcucgggguccugaagcagaaggacaagaacaucagcgacgacaaccggcagaacuggaacaaguccaucaacaacaagcugcgcgaggagcucgagaucuuccagaacgccgagaucgagagcuuccagggccugcggcugcacaucgcgcaguacauccucuacggccgccacuccgaggccgccaugcuggggaaguggaacagcgccgacgaccuggaggaguuccucaaggaguucaagcagcacagccugcggaaccccaucguggagcaggucaucaccgagacccugcgcguggugaaggacaucugggucaaguacggcaacggggccaaggacuucuucaacgagauccacaucgagcucggccgggagaugaagcugcccgcggaggaccgcaagaagaucaccaaccagaucuccgagaacgagaacacgaaccugcggaucaaggcccuccuggccgagaugaugguggacagcuccguggagaacguccgccccuucagcccgaugcagcaggagauccugaagaucuacgaggacggggugcucaacuccgacaucgagaucgaggacgacauccugaagaucagcaagaccgcccagcccucccccagcgaccugaagcgguacaagcucuggcuggagcagaaguacaagucccccuacaccggccagaucaucccgcugaacaagcuguucacccccgaguacgagaucgagcacaucaucccccagagccgcuacuucgacgacuccuucagcaacaaggugaucugcgaggccgcggucaacaagcugaaggacaacuucaucggccugggguucaucaagcaguucggcgggacgaucguggagugcggcaacgggaaguccgugaccguccucaaggaggaccaguacgaggacuucgugaagaagcacuacgccaacaaccgcagcaagcggaacaagcugcugcucgaggacauccccgagaagaugaucgagcgccagaugaacgacacccgguacaucuccaaguacaucagcggcgugcuguccaacaucguccgcaccgaggacggcacggacgacggggugaacagcaagaacaucgugccgggcaacgggaagaucaccaacacccugaagcaggacuggggccucaacgacaucuggaacgaccugauccugccccgguucgagcgcaugaaccagcucaccaacagcacggacuucaccgccuggaacgagaaccaccagaaguuccugcccaccgucccgguggaguucuccaagggcuucagcaagaagcggaucgaccaccgccaccacgcccuggacgcgcucgugaucgccugcgccaccaaggaccacgucaaccugcugaacaaccaguccgccaagagcgacaccaagcggcacgaccucaagcgcaagcugaugaaguucgagaagguggccuacaaccacccccagacgggggagcggaucgagcgcgaggugcccaagcaguuccugaagcccugggagaccuucaccgucgaggcgaagaacggccucgagaccaucaucguguccuucaagcagaaccugcgggugaucaacaaggccacgaaccacuacgagaaguacgucgagaaggacggggccaaggugaagggccgcguggagcaggccgggaccaacugggccauccggaagccgaugcacaaggagaccgucagcggcaagaucgaccugccccgcaucaaggugcccaagggcaagauccucaccgcgacgcggaagaaccuggacaccuccuucgaccugaagaccaucgggagcaucaccgacacgggcauccagaagauccucaagaacuaccugcaguacaaggacaacaaccccgagcuggccuucuccccggaggggaucgaggacaugaacaagaacaucgagaaguucaacgacggcaaggugcaccagcccaucaucaagguccgcaucuucgagcucgggagcaaguucccccugggccaguccggcaacaagaaggacaaguacguggaggccgccaaggggaccaaccuguucuucgccguguacgaggacaagaacggcaagcggagcuacgagaccaucccccucaacgaggucaucgagcgccagaagcaggggcugaccgugguggaccugaagggcgucaacgacuucuaccucuccccgaacgaccugguguacgugcccagcgaggacgagcuggagaacgucuccaugaucgacuacaacaagcucagcaacgagaagguguacaagguggucuccuucacggggaaccagaucuucuucgugcggcaggacguggcgaccagcaucgucaacaaggccgaguucuccagccugaacaagauggagcgcgccaucggcggcaccaugaucaaggagguguucgugaagaucaagaucgaccgccuggggaacaucagcaaggucuga

SEQ ID NO: 2216 - RNA, 4347 nt, Artificial Sequence
  Cas9 variant
augaagcacauccugggccucgaccuggggaccaacagcaucggcugggccguggucaaggaggcccagaacgacaacgagcaguccgagaucguggacguggggguccgcgugaacccccugaccacggacgagaagaccaacuucgagaagggcaagccgaucagcaccaacgcggaccggacccucaagcgcuccgcccggcgcaaccugcagcgguacaagcugcgccggaaggagcucaucgagcugcugaaggagcaccagcucaucagcgagaacacgauccugaccgagaacgggaagggcaccaccuuccagacgcuggagcuccgcgccaaguccgccaaggagaagaucagccugggcgagcuggcccggguguuccucaccaucaacaagaagcgcggguacaaguccagccggaaggcgaagaacggcgacgaggggcagcugaucgacggcauggagaucgccaagcgccuguacgaggagaaccucaccaccgggcagcugucccugcagcuccugaaggagggcaagaagucccugcccgacuacuaccggagcgaccuccaguucgagcuggacaaggucuggaacuuccagaagcagagccacuccgacauccugacggacgaguucuacgcccagcucaagggcaaggggcagcgcgccaccagcgcgcuguuccuggccaaguaccagaucuacaccgccgagaacaagggcucccgggaggacaagaagcuccaggccuaccaguggcgcguggacgcccugagcaaggagcugacccgggaggagcucgcguucgugaucacggagaucaacaacaaccugaacaacuccagcggguaccugggcgccaucuccgaccgcagcaaggagcucuacuucaacaacgagaccgucggcgaguaccuguggaagcagaucgccgccaacccccacaacagccugaagaaccagguguucuaccggcaggacuaccucgacgaguucgagcagaucuggaagacccaguccgccuucuaccccgagauccugaccgacgagcugaagaaggagcuccgcgacguggucaucuucuaccagcggaagcucaagagccagaagucccuggugagcuucugcgaguucgagaacaaggagaucgagaucaagaacgaggacgggacgaccaccaagaaggugaucggccugaaggucgcgccgaaguccagcccccuguuccaggaguucaagaucuggcagaaccugaacaacgugcucauccgcaagaagggguccaagaccaagaagguggccaagaaccagcaggccguccuguucgaggaggagaagacgaucagcgagcuggaccuggaggccaagcaggcccucuucaacgagcugaaccugaagggcaaccucaaggcggacuacugccuggagauccugggguacucccccaaggagugggagaugaacuacagcauccucgagggcaaccgcaccaacaaggcccuguacgaggccuaccugaagaucaccgaccucgagggcuacgacgccaagaaccaccugaaggugaagcugaacaaggacgagguggagcucgacgaccugaagguccccgccuccgagaucaaggacauggugcaggcgaucuucaaggaggccgggaucaacaccgacauccugcacuucaacgccgagcucgacggcaaggacuucgagaaccaggccagcuaccagcuguggcaccuccuguacuccuacgagggggacgacagcaaguccggcaacgagcugcuguacaagcuccuggagacgaaguucggguucaagaaggaguacgcgcagauccuggccaacgugagccucuccgacgacuacggcaaccugagcaccaaggccaugcgggagaucaucacccaccugaagcagggcuucccguucaccgggcgcaaggaccggcccgacgagcccuccgccugcgaguucgccggcuacaagcacagcaagcacagccucacgaaggaggagaacgagaagcgcguccugaaggacucccuggaggugcucaagaagaacagccugcggcagcccgucguggagaagauccugaaccagaugaucaaccucgugaacgcgcugcugaagaaguaccgcaccgagaacccgaacuucaaguucgacgagauccggaucgagcucgcccgcgagcugaagaagaaggccgaggagcgggccaacaugaccgccaacaucaacaaggcgaagaccgagcacgagaagaucaucaagauccugaagaacgaguucgggcuccccaaccccacgcgcaacgacaucauccgguaccgccuguacgaggagcugaaggacaacggcuacaaggaccucuacaagggggacuacaucccccgggagaagcuguucuccaaggagaucgacaucgagcacaucaucccgaaggcccgcgucuucgacgacagcuucuccaacaagaccaucaccuaccggaagaccaaccuggagaagggcgagcgcaccgccuacgacuacaucgagagccucggcgagaagcagcuggaggaguuccugucccggaucgagaaccucuacgagaucgggaagcccagccgccugcacaaccggcgcaacccccugaagaagguggaggagaagggcaucuccgacagcaaguacaagaagcuccugaagaaggaguccgagaucggggacggcuucguggagcgcgaccugcgggagacgcaguacaucgccaagaaggccaaggagauccuccugcagaucacccgcagcguccuguccaccagcggcgggaucaccgaccggcuccgcgaggacugggaccugaucaacgugaugaaggagcugaaccuccccaaguaccgggcgcugggccugacgaagauggaggaccgcaaguacgggcagcaggucgaggugaucaccgacuggaccaagcggaacgaccuccgccaccacgccauggacgcccugaccguggccuucacgaagcacaaccacauccaguaccugaacuaccucaacgcgcggaagaacgagaagcacaaggagcacaacaacaucauggccauccagcagcuggagaccaucaaggugaccgacgagaacggcaacgagaagcgcaucuucaaggccccgaugcccaacuuccggcaggucgccaaggccuuccuggagaacgugcucaucucccacaaggcgaagaacaagguggucaccaagaacaagaacaagaucagcgggaacaacaaggugcaggaggugcugacgccccgcggccagcugcacaaggagaccaucuacggcaaguaccaguacuacguccagaaggaggagaagaucgggggcaaguucgaccucgagaccaucgagaagguggccaacccccuguaccagucccugcucaagaagcggcuggaggagaacgggggcgacccgaagaaggccuucaccgggaagaacagccuggccaagaaccccaucuaccucgacgaggcccagacggagcagcugcccgagaaggugaagcuggucuggcucgagaacagcuucuccauccgcaaggacaucacccccgagaacuucaaggacgagaagcugaucgacaagauccuggacgagggcgugaagcggauccucaaggagcgccugcagagcuucggcaacgacgcgaagaaggccuucuccgaccuggagaagaacccgaucuggcucaacaaggagaaggggaucgccaucaagcgggugaccaucagcggcgucgccaacgccgagccccugcacaccaagaaggaccaccuggggaaggagauccucgacaaggagggcaagcccaucccgguggacuucaucuccacggggagcaaccaccacguggcggucuaccgcgacgagaagggcaaccugcaggagaaggugguguccgucuucgaggccguggugcgggccaaccagggccugcccaucaucgacaagaccuacaaccaguaccucgggugggaguuccuguucagcaugaagcagaacgagauguucgucuuccccaacgaguccaccggcuucaaccccaacgacaucgaccugcuggacccgaagaacaagaagaucaucagccccaaccucuuccgcgugcagaagcuggccaccggggacuacugguuccggcaccaccuggagacgaccguggagaccaaguccgcgaccaaggacaugacguacaagcgccucagccugaaccacaucaagaacaucaucaagguccgcaucaaccaccugggcgacaucguguccgugggggaguacuga

SEQ ID NO: 2217 - RNA, 4353 nt, Artificial Sequence
  Cas9 variant
augaagcacauccugggccucgaccuggggagcaacuccaucggcugggccuucgugcagcaggacuucgagaacaagcaggggaagaucaucgccaccggcagccgcaucauccccauggaccaggggauccugggcgacuucgagcggggcaacaccgucucccagacggcggagcgcaccaccuaccggaacacccgccggcuccgcgagcggcaccuccugcgccgggagcgccuccaccgggugcugcacauccugggguuccucccgccccacuacgacagccagaucgacuucacgaagcgcuacggcaaguucaucgacaacgccgagcccaagaucgccuacaacaacgggaacuucaucuucaugaacuccuucaacgagaugaucgaggacuucaagaaguaccagccccagcuguucuacaagaaguccaacggcgaggaguccaagaucccguacgacuggaccaucuacuaccugcggaagaaggcccucagccagaagaucacccagcaggagcuggccuggcugauccuccacuucaaccagaagcgcggguacuaccagcugcggggcgaggaggagaccgagaaccccaacaaggagguggcguuccacucccuggaggucguggacguggaggccgaggcccccaacaagaagggcgagaucugguacacgauccgccucgagaacggguggaucuaccggcgcaccagcaagaucccccuggacgacuggaagggcaagacccgggacuucaucgucaccacggaccugaacgacgacgggaccaucaagcucgacaaggagggcaaggagaagcgcuccuuccgggccccggacgagaacgacuggaaccugcugaagaagaagaccgagcacgacaucgacuucagcggcaagaccgugggggcguacaucuacgaccaccuccugcagaaccccaaccagaagaucaagggcaagcuggugcgcacgaucgagcgcaaguacuacaaggacgagcucaaggccauccuggccaagcagaucgcccugcagcccgagcuguucaccgagacccugcuggccgacugcauccgggagcucuaccgcaagaacgagacccagcagcagaaccugcuguccaaggacuuccuccaccuguucgucgaggacaucaucuucuaccagcggccccugcgcagcaagaaguccacgaucgcgaacugcacccucgagaagcggagcuacaucgacaaggagaccaacgagcgcaaggacaccccgaucaaggugugcgccaaguccaaccccuacuaccaggaguuccgggugcugcaguggcugcagaaccuccgcaucuacgagaucgagacggaccgggaggucaccgccgaguucaucgagaccgcccaggacaacgaggcccuguucaacuuccugaugagccagaaggagaucgacaacgagucccuccugaaguacuuccuguucgcgaagaacccccagaucaaggacaagguggccaagagcgagcucaagaaguggcugaccacguaccgcuggaacuacguguacgacgccgccgacaacagcuccaagaaguaccccaugaacgagaccggguacgagcugcagcaguaccugcagaaggucgagggccucccggccaacuuccugaccuucgacaucaccuaccggcuguggcaccuccuguacagcgugaaggacaagguggaguucgagaaggcgcugaagaaguucgcccaggaguaccagcucgacgaggccuccuucgucgacagcuucaagaacuucaagcccuaccccaacgaguacggguccuucagcgagaaggccaucaagaagcugcugccccucaugcgcuucggcaaccacugggacuucaaccggaucgacguguccacgcagaagcgcaucgacgaccugaucaacggcguggccaacgacgagauccggaccaucauccgcgagaaggcggagaaguaccagcugaacagcgagaccugcuuccaggggcucccgcuguggcuggcccaguacgucguguacaaccggcacgccgaggccgcggacaucgagaaguggaccuccgugaacgaccucgaggccuaccuggaggacuucaagcagcacagccugcgcaaccccaucgucgagcaggucaucacggagacccuccggguggugcgcgacaucuggcagcgcuacggcgggggccaggccaacuucuucgacgagauccacaucgagcuggggcgggagcugaagaagaccgccgaggagcgcaagcagcucuccaaccggaaccaggagaacgagaacaccaaccugcgcaucaagaagcugcucgccgagcugaaggaggacgcgagcauccagaacgugcggcccuacucccccguccagcaggagcugcucaagaucuacgaggagggcguguucagcgccaccgacgagguggaggaggacauccagaagauccgcaagaaggccgagccgacgacccccgagauccagcgguacaagcuguggcuggagcagaaguacaagucccccuacaccggcgaggucaucagccucaccaagcuguucacggaggaguacgagaucgagcacaucaucccccagucccgcuacuacgacgacagccuguccaacaaggugaucugcgagagcgccgugaacaagcucaagaccaaccagcuggggcuggaguucauccagaaccaccacggcgagaagguccggaucaccgccaacaaggaggugaccaucuucacggaggagcaguacaaggaguucgugaagaagcacuacgcgaacaacagcgccaagcagcagaagcuccugcugaacgagaucccggagaagauggucgcccgccagcucaacgacacccgguacaucuccaaguacaucagcgagauccuguccaagaucgugcgcagcgacgagaaggacgagggggugaacuccaagaacaucauccccugcaccggcaagaucaccacggcccugaagcaggacugggggcucaacgacgucuggaacgagcugauccugccccgguucgagcgcaugaaccagcucacccagacccagcuguucaccagcuacaacgaccgguuccagaagaaccugccgacggugcccaucgaguacucccagggcuuccagaagaagcgcaucgaccaccggcaccacgccauggacgcgcucgugaucgccugcgccacccgcgagcacaucaacuacaugaacaaccagcacgcccuggacaagagcaaggacaagaaggagaagcagcagucccggaucgaccugcgcaccauccucugcgagaagaagaacaacaacuggcaguucaagaagcccuggagcaccuucacgcaggaggcgcaggaggcccuggagcacaucgucguguccuucaagcagaaccugcgggugaucaacaaggccaccaacuacuacgagaagugggaggagaagaacggcguccucgugaagaagaaggugaagcaggaggggaccaacugggccauccgcaagccccugcacaaggagaccgucagcggcaagaucgugcuggaccgcaagaucgggaaggacaagauccucacggccacccggaaguccguggacaucaccuucaccgagaagaucaucagcuccaucacggacaccggcauccagaagauccugcugaacuaccucaaguacaagggcagcccggaggucgcguucuccgccgaggggcuggaggagcugaacaagaacaucgcccaguacaacgacggcaagaagcaccagcccaucuacaaggugcgcaucuucgaggaggggagcaaguucccccucggcgagaccggggccaaggccaccaaguacguggaggcggccaagggcacgaaccuguucuucggcgucuaccaggggaagggcaagcggaccuacgccaccaucccccugaacgaggugaucgagcgccagaagcaggggcucccgagcgugcccgagcggaacgagaagggcgagccccugcuguucucccucagccccaacgaccuggucuacgugccgauggagggggagaucgccgagaccaucgacuucaacaaccuguccaaggagcagaaggagcgcaucuacaagacggugagcuucaccggcaaccagugcuucuucguccaggaggccguggcgacccccaucgugaacaagaucgaguacagcccccucaacaagauggagcgggacauccugggcaccaugaucaaggaggucugcaucaagcugaagguggaccgccucgggaacaucaccaaggccuga

SEQ ID NO: 2218 - RNA, 4353 nt, Artificial Sequence
  Cas9 variant
augaagcgcauccugggccucgaccuggggagcaacuccaucggcugggccuucguggagcaggacuucgagaacaagcaggggaagaucaucgccaccggcagccggaucauccccauggaccaggggauccugggcgacuucgagaagggcaacaccgucucccagacggcggagcgcaccaccuaccggagcaugcgccggcuccgcgagcggcaccuccugcgccgggagcgccuccaccgggugcugcacauccugggguuccucccgccccacuacgacgcccagaucgacuucaccaagcgcuacggcaaguucaucgacaacgccgagcccaagaucgccuacaacaacgggaacuucaucuucaugaacuccuucaacgagaugaucgaggacuucaagaaguaccagccccagcuguucuacaagaaguccaacggcgaggagagcaagaucccguacgacuggacgaucuacuaccugcggaagaaggugcucagccagaagaucacccagcaggagcuggccuggcugauccuccacuucaaccagaagcgcggguacuaccagcugcggggcgaggaggagaccgagaaccccaacaaggaggucgcguuccacucccugaaggugguggacgucgaggccgaggcccccaacaagaagggcgagaucugguacaccauccgccucgagaacggguggaucuaccggcgcacgagcaagaucccccuggacgacuggaagggcaagacccgggacuucaucgugaccaccgaccugaacgacgacgggacgaucaagguggacaaggagggcaaggagaagcgcuccuuccgggccccggacgagaacgacuggaaccuccugaagaagaagaccgagcacgacaucgacuucagcggcaagaccgucggggcguacaucuacgaccaccuccuccagaaccccaaccagaagaucaagggcaagcuggugcgcaccaucgagcgcaaguacuacaaggacgagcugaaggccauccucgccaagcagaucgcccugcagcccgagcuguucacggagacccuccuggccgacugcauccgggagcuguaccgcaagaacgagacccagcagcagaaccuccuguccaaggacuuccugcaccucuucguggaggacaucaucuucuaccagcggccccugcgcagcaagaaguccaccaucgcgaacugcacgcuggagaagcggagcuacaucgacaaggagaccaacgagcgcaaggacaccuucaucaaggucugcgccaaguccaacccguacuaccaggaguuccgggugcuccaguggcugcagaaccugcgcaucuacgagaucgagaccgaccgggaggugacggccgaguucaucgagaccgccgaggacuacgaggcccucuucaacuuccugaugagccagaaggagaucgacaacgaggggcugcucaaguacuuccuguucgcgaagaacccccagaucaaggacaaggucgccaaguccgagcugaagaaguggcucaccaccuaccgcuggaacuacguguacgacgccgccgacaacagcagcaagaaguaccccaugaacgagacgggcuacgaccugcagcgguaccugcagaagguggaggggcugcccgccaacuuccucaccuucgacaucaccuaccgccuguggcaccuccuguacuccgucaaggacaagguggaguucgagaaggcgcugaagaaguucgcccaggaguaccagcuggacgaggccagcuucguggacuccuucaagaacuucaagccguaccccaacgaguacggcagcuucuccgagaaggccaucaagaagcuccugccccugaugcgguucggcaaccacugggacuucaaccgcaucgacgucagcacccagaagcggaucgacgaccucaucaacgggguggccaacgacgagauccgcacgaucauccgggagaaggcggagaaguaccagcugaacuccgagagcugcuuccagggccugccccucuggcuggcccaguacguggucuacaaccgccacgccgaggccaccgacaucgagaaguggaccuccgugagcgaccuggagaccuaccucgaggacuucaagcagcacucccugcggaacccgaucgucgagcaggucgugacggagacccugcgcguggugcgcgacaucuggcagcaguacgggggcgggcaggcgaacuucuucgacgagauccacaucgagcucggccgggagcugaagaagaccgccgaggagcgcaagcagcugagcaaccggaaccaggagaacgagaacaccaaccuccgcaucaagaagcugcuggccgagcucaaggaggacgccuccauccagaacgugcggcccuacagccccguccagcaggagcugcugaagaucuacgaggagggcguguucuccagcaccgaccagguggaggaggacauccagaagauccgcaagaaggccgagcccacgaccccggagauccagcgguacaagcucuggcuggagcagaaguacaagucccccuacaccggggaggucaucagccugaccaagcuguucacggaggaguacgagaucgagcacaucaucccccagucccgcuacuacgacgacagccugagcaacaaggugaucugcgaguccgcggugaacaagcugaagaccaaccagcucggccuggaguucauccagaaccaccacggggagaagguccggaucaccggcaacaaggaggugaccaucuucacggaggagcaguacaaggaguucgugaagaagcacuacgccaacaacagcgccaagcagcagaagcugcuccugaacgagauccccgagaagauggucgcccgccagcugaacgacacccgguacaucuccaaguacaucagcgagauccucuccaagaucgugcgcagcgacgagaaggacgagggggugaacuccaagaacgucaucccgugcaccggcaagaucaccacggcccugaagcaggacuggggccugaacgacguguggaacgagcucauccugccccgguucgagcgcaugaaccagcugacccagacccagcuguucaccagcuacaacgaccgguuccagaagaaccugcccacggugccgaucgaguacucccagggguuccagaagaagcgcaucgaccaccggcaccacgcgauggacgcccuggucaucgccugcgccacccgcgagcacaucaacuacaugaacaaccagcacgcccucgacaagaacaaggacaagaaggagaagcagcagagccggaucgaccugcgcaccauccugugcgagaagaagaacaacaacuggcaguucaagaagcccugguccaccuucacgcaggagaccaaggaggcgcucgagcacaucguggugagcuucaagcagaaccugcgggucaucaacaaggccaccaacuacuacgagaagugggaggagaagaacggcgugcuggugaagaagaaggucaagcaggaggggaccaacugggccauccgcaagccccuccacaaggagacgguguccggcaagaucgugcuggaccgcaagaucggcaaggacaagauccugaccgccacccggaaggaggucgacaucaccuucacggagaagaucaucagcuccaucaccgacaccgggauccagaagauccuccugaacuaccugaacuacaagggcagccccgagguggcguucuccgccgaggggcucgaggagcugaacaagaacaucgcccaguacaacgacggcaagaagcaccagccgaucuacaaggugcgcaucuucgaggaggggagcaaguucccccugggcgagaccggcgccaaggccacgaaguucgucgaggcggccaaggggaccaaccucuucuucggcguguaccaggggaaggagaagcggagcuacgccaccaucccccugaacgaggugaucgagcgccagaagcagggccugcccuccgucccggagcggaacgagaagggggagccccuccuguucagccugucccccaacgaccucguguacgugcccauggagggcgagaucgccgagaccaucgacuucaacaaccugagcaaggagcagaaggagcgcaucuacaagacggucuccuucaccggcaaccagugcuucuucgugcaggaggccguggcgaccccgaucgucaacaagauggaguacagcccccugaacaagauggagcgggacauccucgggaccaugaucaaggaggugugcaucaagcugaagguggaccgccugggcaacaucaccaaggccuga

SEQ ID NO: 2219 - RNA, 4353 nt, Artificial Sequence
  Cas9 variant
augaagcacauccugggccucgaccuggggagcaacuccaucggcugggccuucgugcagcaggacuucgagaacaagcaggggaagaucaucgccgcgggcagccgcaucauccccauggaccagaagaugcuguccaacuucgaggaggggaccaccgucagccagacggccgagcggaccaccuaccgcuccaugcggcgccuccgggagcgccaccuccugcggcgcgagcggcuccaccgcgugcugcacauccugggcuuccucccgccccacuacgacgcccagaucgacuucaccaagcgguacggcaaguucaucgacaacgccgagcccaagaucgccuacaacaacgggaacuucaucuucaugaacagcuucaacgagaugaucgaggacuucaaggagcaccagccccagcuguucuacaagaaguccaacggcgaggagagcaagaucccguacgacuggacgaucuacuaccugcgcaagaaggcgcucucccagaagaucacccagcaggagcuggccuggcugauccuccacuucaaccagaagcggggguacuaccagcugcgcggcgaggaggagaccgagaaccccaacaaggagguggccuuccacagccugaaggucguggacguggaggccgaggcgcccaacaagaagggggagaucugguacaccauccggcucgagaacggcuggaucuaccgccggacguccaagaucccccuggacgacuggaagggcaagacccgcgacuucaucgucaccaccgaccugaacgacgacgggacgaucaagcucgacaaggagggcaaggagaagcggagcuuccgcgccccggacgagaacgacuggaaccugcugaagaagaagaccgagcacgacaucgacuucuccgggaagcccgugggcaccuacaucuacgaccaccuccugcagaaccccaaccagaagaucaagggcaagcuggugcggaccaucgagcgcaaguacuacaaggacgagcucaaggccauccuggccaagcagaucgcccugcagcccgagcuguucacggagacccugcuggcggacugcauccgcgagcucuaccggaagaacgagacccagcagcagaaccugcugagcaaggacuuccuccaccuguucgucgaggacaucaucuucuaccagcgcccgcugcgguccaagaaguccaccaucgccaacugcacgcucgagaagcgcuccuacaucgacaaggagaccaacgagcggaaggacacccccaucaaggugugcagcaaguccaaccccuacuaccaggaguuccgcgugcugcaguggcugcagaaccuccggaucuacgagaucgagaccgaccgcgaggucacggccgaguucaucgagaccgcccaggacuacgaggcccuguucaacuuccugaugagccagaaggagaucgacaacgagagccuccugaaguacuuccuguucgcgaagaacccccagaucaaggacaagaccgccaagaucgagcucaagaaguggaucaccacguaccgguggaacuacguguacgacguggccgacaacuccagcaagaaguacccgaugaacgagaccggguacgaccugcagcgcuacaugcagaaggucgagggccugcccaccaacuuccugaccuucgacacgaccuaccggcucuggcaccuccuguacuccgugaaggacaagguggaguucgagaaggcccucaagaaguucgccaagaagaagcagcuggacaagaccagcuucgucgacuccuucaagaacuucaagcccuaccccaacgaguacgggagcuucuccgagaaggcgaucaagaagcugcucccgcugaugcgcuucggcaaccacugggacuucaaccggaucgacgugagcacccagaagcgcaucgacgaccugaucaacgggguggccaacgaggacauccggacgaucauccgcgagaaggccgagaaguaccagcucaacuccgagaccugcuuccaggaccugccccuguggcucgcccaguacgucguguacaaccggcacgccgaggcgaccgacaucgagaaguggaccagcguguccgaccuggaggccuaccuggaggacuucaagcagcacagccuccgcaaccccaucgucgagcaggucgugaccgagacgcugcggguggugcgcgacaucuggcagcaguacggcggcgggcaggccaacuucuucgacgagauccacaucgagcugggccgcgagcucaagaagaccgccgaggagcggaagcagcuguccgacaagaaccaggagaacgagaacaccaaccugcgcaucaagaagcuccuggcggagcugaaggaggacgccagcauccagaacguccggcccuacucccucgugcagcaggagcugcugaagaucuacgaggaggggguguucagcuccaccgacgagaucgaggaggacauccagaagauccgcaagaaggucgagccgacgacccccgagauccagcgguacaagcucuggcuggagcagaaguacaagagccccuacaccggcgaggugaucucccugaccaagcuguucacggaggaguacgagaucgagcacaucaucccccagagccgcuacuacgacgacagccuguccaacaaggugaucugcgagagcgccgucaacaagcugaagaccaaccagcucgggcuggaguucauccagaaccaccacggcgagaaggugcggaucaccgccaacaaggaggugaccaucuucacggaggagcaguacaaggaguucgucaagaagcacuacgccaacaacuccgcgaagcagcagaagcugcuccugaacgagaucccggagaagaugguggcccgccagcugaacgacacccgguacaucagcaaguacaucuccgagauccucagcaagaucgugcgcuccgacgagaaggacgagggcgucaacagcaagaacaucauccccugcaccgggaagaucaccacggcccugaagcaggacuggggccugaacgacguguggaacgagcucauccugccccgguucgagcgcaugaaccagcugacccagacccagcuguucaccuccuacaacgaccggcuccagaagaaccugccgacggugcccaucgaguacagccagggguuccagaagaagcgcaucgaccaccggcaccacgccauggacgcccucgucaucgcgugcgccacccgcgagcacaucaacuacaugaacaaccagcacgcccuggacaaguccaaggacaagaaggagaagcagcagagccggaucgaccugcgcaccauccucugcgagaagaagaacaacaacuggcaguucaagaagcccuggcggaccuucacgcaggaggccaaggaggcccuggagcacaucgugguguccuucaagcagaaccugcgcgucaucaacaaggcgaccaacuacuacgagaagugggaggagaagaacggcgugcucgugaagaagaaggucaagcaggaggggaccaacugggccauccggaagccccugcacgaggagaccuucagcggcaagaucucccugaaccgcgagaaggugggcaaggggaacauccucacggccacccgcaaggccguggacagcuccuucgacgucaagaagaucagcaagaucaccgacaccggcauccagaagauccugcugaacuaccucaaguacaaggggagcccggagguggcguucuccgccgagggccuggaggagcugaacaagaacaucgcccaguacaacaacggcaagaagcaccagcccaucuacaaggugcggaucuacgagaaggggagcggccgcuucguccucggggagaagggcacgaaguccaagaaguacgugcagggggcccccaaccuguacuucggcguguaccagggcaaggagaagcggaccuacgccaccaucccccugaacgaggucaucgagcgccagaagcaggggcucccgagcgugcccgagcggaacgagaagggcgagccccugcuguucucccucagccccaacgaccugguguacgucccgauggagggggaggcgaccgagacgaucaacuucaacaaccugaacaaggagcagaaggagcgcaucuacaagaccguguccuucaccggcaaccagugcuucuucgugcaggaggccgucgccagccccaucgugaacaagauggaguacagcccccucaacaagauggagcggagcaucguggggaucaugaucaaggaggucugcaucaagcugaagguggaccgccugggcaacaucaccaaggccuga

SEQ ID NO: 2220 - RNA, 4362 nt, Artificial Sequence
  Cas9 variant
augaagaccgugcugggccucgaccuggggaccaacagcaucggcugggcccugauccagcacgacuucgacuccaagaagggggagauccucggcauggggagccgcaucauccccaugucccaggacauccugggcgaguucggcaaggggaacagcgucucccagacggccgaccggaccaaguuccgcagcgcgcggcgccugcgggagcgccaccuccugcggcgcgagcggcugcaccgcgugcucaacauccugggcuuccugccgcggcacuacgccgccgacaucgacuucgagaagcgccucgggcaguucuucgagggcaaggagcccaagcuggccuacgacaacaaccaguucaucuucaccaaguccuucgggaagaugcuggccgacuuccggcagcaccagcccgacuuccucaaggacgagaaguccaacgaccugcugauccccuacgacuggagcaucuacuaccuccgcaaggaggcgcugaccaagaagaucgagaaggaggagcuggccuggaucauccucaacuucaaccagaagcggggcuacuaccagcugcgcggcgaggaggaggaggagaaccugaacaagcucguggaguuccacagccugaagaucaucgacgucguggccgacgagaagcugaacaacaagggggagacgugguacucccuccugcuggagaacggcuggaccuaccggcgcagcuccaaggugccccucuucgacuggaaggagaagguccgggacuucaucgugaccaccgacaucaacgacgacgggagcgugaagacggacaaggagggcaacgagaagcgcuccuuccgggcccccagcgacgacgacuggacccugcugaagaagaagaccgagcaggacaucgacaagucccgcaagcccaucggcgcguacaucuacgacgccauccucaagaaccccaagcagaagaucaacgggaagcugguccgcaccguggagcggaaguucuacaaggaggagcugaagcucauccugcagaagcagaaggaguuccacccggagcugcagagcacggaccucuacaacgagugcauccgcgagcuguacaagaacaacgacgcccaccagcugcagcucaacaagaaggacuucgugcaccuguuccuggaggacaucaucuucuaccagcggccccuccgcucccagaaguccagcgucggcaacugcccccuggaguuccggaaguucaaggacagcgaggggaucgagaagguggaguaccugaagaccauccccaagagcaacccguacuuccaggaguuccgcaucuggcaguggauguacaaccucuccaucuacaagaaggacgacgacgagaacgugacccgggacuuccugaagaccaucgaggacugggaggaccuguucgaguuccugaaccaccgcaaggacaucgagcaggagacgcuccugaaguuccugcucggcaagaacggggucaagggcaaggcccugaagguggaggccggcaaguuccgguggaacuacgugagcgacaagaucuaccccugcaacgagaccaaggcgcugaucaucuccaagcucgagaaggucaaggggguggaggagaaguuccugaccgaggagaucgaguacaagcuguggcaccucaucuacagcgugaccgacaaggucgaguacgagaaggcccugaaggccuucgccggcaagcagaagcuggaccucguguccuucguggacagcuucaagcgcuucccgcccuucaagaacgaguacggggccuacuccgagaaggcgaucaagaagauccugccgcugcuccggacgggcaagagcuggaacuggauggccaucgacuccaagguccgcgaccggaucaacaagaucaucaccggggaguucgacgaggagaucaagaacaaggugcgcgagaaggccgagaagcacagccugaagaaggagaacgacuuccagggccugccccucuggcuggcccaguacgucguguacggccggcacuccgaggccagcuucuccgggaaguggaacagcguggacgaccugaagaaguaccucgaggaguucaagcagcacucccugcgcaaccccaucgucgagcagguccugaccgagacccuccgggugguggcggacaucuggcaguucuacggcaagggggagaaggacuucuucagcgagauccacaucgagcugggccgcgagaugaagaacacggccgaggaccggaaggagauguccgccaucauccaggccaacgagaccaccaaccugcgcaucaaggcccuccugaacgagcugcuccaggacaagaagguggagaacgugcgccccuacagcccgagccagcaggagauccugaagaucuacgaggacgggguccuguccagcgacaucgagauccccgacgacauccagaagaucuccaaggcggcccagcccaccaagagcgagcuccagcgguacaagcuguggcuggagcagaaguaccgcucccccuacacgggcgccaugaucccgcucggcaagcuguucaccagcgaguacgagaucgagcacaucaucccccagucccuguacuucgacgacagcuucuccaacaaggugaucugcgagagcgccgugaacaagcucaaggacucccggcuggggauggaguucaucaaggagugccacggcauggucguggagaccggguucggcaagagcgugaccgucuucgaggaggagacguaccgcgacuucguggugcagaacuacuccaagaaccacagcaagaaguccaagcugcuccuggaggagauccccgagaagaugaucgagcggcagaugaacgacacccgcuacaucagcaaguucaucuccagcguccugagcaacaucgugcgggaggaggugaacgacgacggcgucaacuccaagaacaucgugcccgggaacggcaagaucaccacccagcucaagcaggacugggggcugaacgacaucuggaacgagcugauccucccgcgcuucgagcggcugaacgugcugacggacagcaagcacuucaccgcgugguccgagaaccaccagcgccuccugcccaccguccccaucggccugagcaagggguucuccaagaagcggaucgaccaccgccaccacgcccucgacgcccuggugaucgccugcgccagccggaaccacaucaacuuccugaacaacgcgcacgccaucgacaagaagaagaacuccgaggagaagcagaaguuccgccacgaccucaaggccauccugugcgacaagaaguacagcgacaaguccgagaagaacuaccgguggaucuucaagaagccgugggacaacuucaccaucgacagcaagaacgcccuggacaagaucaucguguccuucaagcagaaccuccgcaucaucaacaaggccaccaaccgguacgagaagugggucgaccgcgacggcaucaaggugaaggaguggcacaagcaggagggcaucaacugggcgacgcggaagccccugcacaaggacaccgugagcgggaaggucgaccugaagcgcgugaccgugcccgagggcaagauccucaccgccacgcggaagucccuggacaccagcuucgaccugaaggucaucgaguccaucaccgacaccgggauccagaagauccucaagaacuaccugacgagcaaguccaacaaccccgagcuggccuucagcuccgagggcguggaggacaugaacaagaacauccgcaaguacaacgacgggaagcuccaccagccgaucuacaaggugcgcaucuucgagcugggcagcaaguucccccugggccaguucgggaacaagaaguucaaguacgucgagaccgccaagggcaccaaccucuucuucgccguguacgaggacgagaacaagaaccggaacuacgagaccaucccccugaacguggucaucgagcgccagaagcaggggcugagcuccgugcccaucaagagcgagaagggccacaagcuccuguucuaccuguccccgaacgacaucguguacguccccgggagcaacgaggaguucuccaucgaccggcucuaccgcuucacggacagcuccgacaagaccgcgaacuucaucccccugagcguguccagccugaucuucuccagcaacaagaacgagcagaagaagaucggcaucuccuaccccauccaggacgaguucggccucgggagcccgcaguccaagaaccagaaguccaucgacggcaucaugaucaaggagaagugcgugaaggucaacaucgaccggcuggggcgcgugagcuucuga

SEQ ID NO: 2221 - RNA, 4368 nt, Artificial Sequence
  Cas9 variant
auggccaagauccugggccucgaccuggggaccaacagcaucggcugggccguggucgaggaccagaacaacaagaccacgcugaucgacaagggggugcgcaucuucagcgagggcgugaagaucgagaaggggaucgagaaguccaaggcggccgagcggaccgacuuccgcagcgcccggaagaucaaguuccgccggcgccuccggaagcaggagacccugaagguccugaucgagaacaacaugugcccccucaccaucgaggaguggacgaaguggaagaaggacaagaaggaguacccgaagaaccccgacuucaucaacuggcugaagaccgacgagcugaagaacaucaaccccuacuucuuccgcgacaaggccagccggaccgagcucccccugaugcagaccggccgcgcccuguaccaccucgcgcagcggcgcggcuuccuguccaaccggcuggaccaggggagcgacggcuucacggagcagauccgccucgaccugaucaagaagaucgagugcgagaccgacaagaccgagcugcucaccuccgugcagagcaucaucgacacguacuccgaggaggaggacaaggacgccaagaagcugcugaaggggguggagaagcucugcaagaucaacaacgagcugccgaucaccgaguucaaggagaagcugaucaacuaccucaacaaggccgacaaccugggcgccgucaagaaggggaucgcggacgugagcaagaagaucaccgagaccggcugcgagacgcugggccaguacuucuacaagcucuaccagaaccaguccaagauccggaagguguacaccgcccgcaccgagcacuacuaccacgaguuccugaagaucugcgagacccagaacaucugcgaccagcugaagcacaagcucgacaaggccaucuucuaccagcggccccucaagagccagaaggggcugaucggcaagugcgucuucgagaagaacaagacgcgcugcgccgugucccaccccgccuacgaggaguaccgggcgcuccaguucaucaacagcaucaagguguccgagaccaaggacgggaagaaggacuuccugagcuucgacgagcgcaagaagaucuggcccaaguucauccggaaguccaagccgaacuucgacuucaaggagaucgccgagacccuggacaagaagggccucagccgcuacuacaacuacaccggccacacguccgucagcgggugccccaccaucgcccagcugaccaacaucuucggcgagaacuggcaggagacccuguucgagaaguacacgaacaagcagaacaccaaggggcucaagaccaucgacgagguggugaccgacaucuggcacguccuguucacguucgacaaggacgagaagaucaucgaguucggcaagcagaagcuggggcucaacgaggugcuggccaagaaguucggcgccaucaaccugaagaaggacuacgcgagccucucccugaaggccaucaacaagauccugcccuaccuccgcgagggccugaucuacagcuacgccguguuccuggccaacaucgagaacgucgugggggaggagaucuggaagaacgacgagaacaagaaccugaucaagaaggagcuccaccuccugaucgacaacuucaacgagaucaagggccuggaggccguggucaacgacuucaucgcggacuucaagaaggaguacaacaacgcccacaaggacuacgugcuggacgagcaggacaagaagauccugcucgagaagaucgaguccaacuacgggaagaacaaguucgagagccuggagcccgacaagaagaccgagaucaucaacuccaccgagaagaugguggccgagcagcugcggaagcagcgcggcgaguucaucaagccgaagcggcucgacgagaagaucagcgaguuccugaucaacaacuucaacgucaccaagaaguccaucgcccgccuguaccaccccagcgacguggagaucuucaagacggccucccggaacagcgaggggcuccugcugcucggcucccccaucgucagcuccaucaagaaccccauggcgaugcgcgccaugcaccagcugcggaagcuggugaacacccucaucaaggagaacaucaucgacgaggagaccaagaucaacaucgagcuggcccgcgagcugaacgacgccaacaagcgggcggccaucaagaaguggcaggacgagcgccagaaggcccgggaggaguacaagaaguccaucaaggagcuguucaaggccgagugcggcaaggacaucgagccgagcgacagcgagauccugaaguacgagcugugggaggagcagcagcacaucugcaucuacaccgggaagaccaucaacaucugcgacuucaucggcgccaaccccaacuucgacaucgagcacacgauccccaagucccucugcuucgacaacagcaacgagaaccugacccugugcgacauccaguacaaccgcgacgugaagcggaacaagauccccaccgagcucuccgacuacaacagcaucaagccgcgccuggacaaguggcuggucuucaucgacgacuacgagaagcucuacaacacccggaagaaggcgaaggggaucgagacgaaggagcagaaggacaagcgcaucaaggagaagcacuacuacaagcugcaccuggacuacuggaagggcaaguacaagcgguucaucaugguggacgugcccagcggguucaagaacucccagaucgucgacaccggcaucaucaccaaguacgccaucagcuacaugaaguccaucuuccccaagguguacagcgugaagggcaacaucgucgccgaguuccgcaagaucugggggcuccagaacgacuacgagaagaaggagcgggugaaccacgugcaccacugcaucgacgccaucaccaucgccugcauguccaagcagaaguacgacacgcuggcgaagaucuaccacgaggacgaggccggcuuccacaagaucaagaaggagacccagcuggucagcaagcccuggaccuccuucaccauggacgugcucaacaucgagaaggagaucuucgugagccaccacacgccggacaacaugaagaagcaguccaagaaggucgugcgcgagcgcgggaucaucgcccccaaggugaucuacgagaccgacgccaacaacaacacccugcgggacaaguacggcaagaagaucgucaaggaguacauccugcucaaggacgugaacggcaaccugauccccaucaaggggaagcgccugacccccagcgacaucaucaacaagguggacggcaucgacuacuucucccucaucaucaacgacaagauccaguacuacgaguucgccaagagcaagaagacggggaagaucaucuacaagaaggagccgaucuaccugcagggcgacaccguccgggggucccugcaccucgacaccuucuacggcgcgaucgccaaggacaucaacggcaacaucaucaccaacacgaacgggaagaucgcccccaacuacgugauccgcaaggagcugagcaagcugaaggagaccgacaucgagaacaucguggaccccgucgugcggggcaagaucaucgaggccaagaagaacaagcucaucaccuucaacaaguccggggcggugaucaagaccacgaucuggaugaaggagaaccagaucccgaucaacaagguccgcguguacagcucccugaagaacccccugcccgacuucaagaagcaccgggaccucagccaccugaccuacaagcagcaguacaacgugagcaacgaggagaacuacugccuggccaucuacgagggcaagaacaagaaggggaacgucugccggaccugcgagcucgugaacaugaucgacgccggcaacuacuaccgccuguccaacaagaacuggaagcagcaguaccccaucgugccggagaaggacagcgucaccaacuacucccugaagacgaucaucaccaagggccucauggugcugcuguacgagaagucccccgaggagaucugggagcucaccuacaaccagcagauggagcgccuguacgagaucacccagcuggacacggagaaguccgccgagaucaagcuccuguuccaccaggaggcccgggagaagaaggugaucaccgaguacauggggcugaagaccggcaugaagggcgggaagaacaucgggaagcacaaggaguuccccuggaucaaggucggccccaacagcuucgacgcgcucaucgagggcaucgacuucaagcugaccccgacggggaagaucaucaagcuguga

SEQ ID NO: 2222 - RNA, 4374 nt, Artificial Sequence
  Cas9 variant
augaagaccauccugggccucgaccuggggaccaacagcaucggcugggccaagguguccgucgacgacuacgggaacuaccugcacgacaucaagcucggcagccgcaucauccccaugucccaggacgugcuggggaacuucgacagcggcgugacggucucccagaccgcccagcggaccgaguuccgcagcaagcggcgccuggugcagcggaaccuccagcgccgggagcgccugcaccgggugcugcacguccucgacuuccugccggcgcacuacgacgccgccaucggcugggaccgcaccgaggccgugacguacgggaaguuccugaaccacgccgagcccaagcucgcgugggaggagcugggcaacgggaagcggcgcuuccuguucauggacuccuuccacgagaugguggccgacuucgcccggugccagcccgcccucgucgcggacggcaagaagaucccccuggacuggaccaucuacuaccugcgcaagaaggcccucacccaggccaucaccaaggaggagcuggccuggauccugcucaacuucaaccagaagcggggguacuaccagcugcgcggcgaggaggaggaggagaacccgacgaagcaggaggaguacuacgagcugaagguggugagcgucgaggccaccgacucccggaagggcaacgacaccugguacaacgugcaccucgagaacggguggaucuaccgccggagcuccaagaucagccuggacgacugggugggcaaggucaagcaguucaucgugaccacggaguacgagaaggacggggcgacccugaagaccgacaaggagggcuacgugaagcgcuccuuccgggcccccaacgagaacgacuggggccuccgcaagaagcgcaccgagacgcugcuggagaugagcgggaagaccgucggcgccuucaucuacgaccaccuccugcaggagcccgccgacaagauccgggggaacuucauccgcaccaucgagcggcacuacuacaaggccgagcuggaggcgauccucgccgagcagugcaaguaccacaucgagcugcgcgacaaggagaugcuggaggccugcgcccgggagcucuaccugaacaaccugccccaccagcgcucccucaugaagaaggacaugaccuaccugcugcucuacgaccugaucuucuaccagcggccgcucaagagcaagaaggcccugaucgcgaacugccccuacgaguacuacgaguacguggacaaggagacgggcgagaucaagcgccagaacaucaagugcaucgccaaguccaaccccuacuuccaggaguuccggcuguggcaguucgugcugaaccuccgccuguucgaccgggucgaggacaaggaggugaccgccaacuaccugcccaccgccgacgaccacgcccgccuguucaccuaccucaacgaccggaaggagaucaaccaggagacgcugcugaaggacuacuucaagcucaagaaggugaagaucgggaacgagaaggaguacccgauccgcuggaacuacaucgaggacaaggagaagaaguaccccugcaacgagacccgguacgagcugcugauggcgcucgaccgcgccggcaucgagcacaaguggcuggacgacaacaaccuggaguaccggcucuggcaccuccuguacagcgucgaggugaaguccgagagcgagaccgcccugcgcaagcugaagaacgacgacgccuucgucaacagcuuccugaaggugaagcccuucaagaaggaguacggcgcguacuccgagaaggccaucaagcggcuccuggccgugaugcgcaagggguuccuguggaacgagcaggacaucugcgacgagacccgcaagcggaucgagaucaucaucaagggcgacgucgacgagaaggugaaggagcgcauggggcacgccgccuacagcuucgaccggguguccgacuuccagggccuccccgaguggcuggcgugcuacgucguguacgggcgccacagcgaggccauggacauccagcacugggacuccccggagcggcugauggccuacaucaacaacuucaagcaguacagccuccgcaaccccaucguggagcagugcauccuggagacgcugcggaccguccacgacaucuggaaggagaccggccagaucgacgagauccacguggagcucggccgcgagaugaaguccaccagcgaggagcgggcccgccggacgcagaacgugcugcgcaacgagaacaccaaccugcggaucaagucccuccugaucgagcugaagaacgacaccgacaucugcaacguccaccccuacagccccaugcagcaggagauccuccgcaucuacgaggagggggcccugcaggagcugaaccgggaggacgaggacuucgaggagaucuccaagaucagccagaugucccagccgagcggcaaggagcucaaccgcuacaagcuguggcuggagcagaaguaccggucccccuacaccgggaaggcgaucagccucgccaagcuguucacgcccgccuaccagaucgagcacgugaucccccagucccgcuacuucgacgacagcuucaccaacaaggugaucugcgaggccgaggucaacacccugaaguccaaccuccugggcuacgaguucaucaagaagcacgggggcgagaucauccacugcaccacccugggcgacgugcggaucuucagcgagagcgaguacaaggccuucgugauggaccacuacgcgaacaacaaguccaagaaggacaagcuccugauggaggacaucccgcaggaguuccugagccgccagaugaacgacucccgguacaucagcaaggucgugaagacgcuccuguccaacaucgugcgcauggccgacgagagcgaggccaccuccaagagcgucaucgugugcaccgggggcgugaccgaccgccugaagaaggacugggggcucaacgacgucuggaacuccaucguguacagccgguucgagcgccugaaccggcugacgggcaccgaggccuucggccacugggagaacaaggacgggaagcgcguguuccagaccuccaugccccucgagcugcagcggggcuuccgcaagaagcggaucgaccaccgccaccacgcgauggacgcccuggucaucgccugcgccagccggaacaucgugaacuaccucaacaacgaguccgccaacaaccccaagaagcgcgaggaccugcggcgccagcugugcgacaagaaccgggugauccgcaagcccugggagaccuucacgcaggacgcguacaacgcccucgagaacgucguggugagcuucaagaacuacguccgggugaucaacaaggccaccaaccgcuacgagcacuacgacgagaacgggaagaagcgguucgugcagcagaagggcuccgagcugugggccauccgcaagccgaugcacaaggagaccuacuacgggcacgucaaccugcggcgcaaggagcucgugacccugcagaaggcccuggacgacauccccagcaucugcgacaagaagcuccgcgacuacaucuccgcgcugguggagaagcacuucaacaagcggcagcugcucgcccacuucaagagcacggacuacuacuggcagaagcaguacgucaacaagguguacguguggaccuucagcgacgacaucaagccccuggucgccacccgcaagcugcucgacaccuccuucgacgccaagcggaucggcacgaucaccgacaccggcauccagaagauccugcgcaacuaccuggaggccaagggcgggaacgcgacccucgccuucacgccggaggggaucgccgagaugaaccagaacaucagcaaguacaacgacggcaagccccaccagcccauccugaaggugcggaucaccgagcccaugggggccaaguaccgcgugggccagaccggcaacaagauggcgaaguacgucgaggcccaguccgggaccaaccuguacuucgccaucuacgaggacagcgagggcaagcgguccuacacgaccgugccgcucgacgagguggccgagcgccugaagcagcggcugagccccguccccgagaaggacgagaacgacgugccccucaaguucuaccuguccccgaacgaccugguguacguccccaccgaggaggagcuccagcugcgcgagugcaagcugaacaaggaccggaucuacaagauggugagcuccaccgggaacgagugccacuucauccccuacuacgucgccaacgugaucuacaacaagggcggguucaacaugcagaugcaccgcccccagagcuga

SEQ ID NO: 2223 - RNA, 4374 nt, Artificial Sequence
  Cas9 variant
auggccaagauccugggccucgaccuggggaccaacagcaucggcugggccaucguggagaagaacaacuccgacuucacccugaucgacaaggggguccgcaucuucagcgagggcgugaagacggagaaggggaucgagcggucccgcgcggccgagcggaccggcuaccgcagcgcccggaagaucaaguaccgccggaagcuccgcaaguacgagacccugaaggugcuguccaagaaccggaugugcccccuccagaucgaggacgucgaggccuggaagaaguccggcuucaaggacuacccgcugauccccgaguuccugcaguggcuccgcaccaacgaccacgagaacgugaaccccuacuucuuccgggacaaggccucccgcgcgaaggugagccugugggagcuggggcgggccuucuaccacaucgcccagcgccggggcuuccucuccaaccgccuggaccagagcuccgaggggguccuggaggagcacaacccccagauccagagccucaucgaggaccuggaggagacguccaccauccugaacgaggugcgggacuacuacaucaaccucggccugcuggacggggugaagggcgacuucaagaaggagcucgacgagggcgagaagaagcucaagagccuguacaacacccugaucgccaucaucaagaagaacgagaacgacguccagaagugcaaggacgagaucaucaagcgccugaacaagaaggaggaccuggggaaggugaagggcaagaucaaggacaucucccaggcgaugcucgacgggaacuucaagacccugggccaguacuucuacagccuguacaacaagggcaagauccggaaccaguacacgucccgcgaggagcacuaccuccaggaguucaucaccaucugcaaggugcaggggaucaacggcaucaacgacgaggagauccugccggagaagaaguucaccgggcuggccaaggaccucuacaaggccaucuucuuccagcggccccucaagagccagaagggccugaucgggaagugcuccuucgagaagaacaagagccgcugcgccaucagccaccccgacuucgaggaguaccgcauguggaacuaccugaacaccaucaaguucggcacgcaguccgacaagaagcugcgguuccugacccaggaggagaagcucaagcugauccccaaguucuaccgcaagaacgacuucaacuucgagguccuggccaaggagcucaucgacaagggcgcgaccuucggguucuacaagagcucccggaagaacgaguuccuguacugguucaacuacaagccgaccgacacggugagcgccugccaguucuccgccagccugaagaacgccaucggcgaggacuggcagaccaagguguucaccuacaagacccucaacuccgagaagaaggaggucauccgcacgguggacuaccgggaccuguggcaccuccugagcgccuccaccagcgacaucuaccuguacgaguacgcgaaggagaagcuggggcuggaggacaaguccgccaagaccuucagcaagaucaagcucaagaaggacuucgccucccugagccuguccgccaucaacaagauccuccccuacaucaaggagggccugcuguacagccacgccguguucauggcgaacaucgagaaggucguggacgagcacaucuggaaggacgugaaggagcgcaccaucauccagaacgagaucuccaagaucaucaagagcgacgucuucgagcgggaggugaucaacaucaucaacgggcucaucaagaacuccaagacggagggcgagaacuacgccgaggagagcaagaacaucuucaagaccgaguucgacaacgccaucgccaagaucuucgagaagaacaacgacaucgaguucaaccagcccuuccuggacgacaccuaccugaaguacguggaggagcucaagaaguucgacaaggcccgcagcuuccugcccgucccgcggcuggacgagaaggugauccaguuccuccugggcaacaacaaggacgggauggucuacugcuccgacaagaacaagaccaagaagcuguaccaccccagcgacaucgagaucuucaagaagaagaucaucaaggacgaguucggcaacgagaagauggugcucgggagcccccugacgaccagcaucaagaaccccauggcgaugcgcgcccugcaccagcuccggaaggugcugaacacccugauccucgaggagcagaucgacgagaacacccgcauccacaucgagauggcccgggagcugaacgacgccaacaagcgcaagggcauccaggacuaccagaacgagaacaagaaguuccgggaggacgcgaucaaggagaucaagaagcuguacuucgaggagugcaagaaggaggucgagccgacggaggaggacgugcuccgcuaccagcuguggaucgagcaggacaagaaggagaucuacgagcaggggaaguccauccggaucagcgacaucaucggcuccaaccccgccuacgacaucgagcacaccgugccccgcagcaucucccagaacaacagccugaugaacaagacccucugcacgccccgguucaaccgcgagaucaagaagcagaagaugccgaucgagcuguccaacuacgaggagauccugccccgcaucgagcacuggaagaaggaggccgaggaccucacccggcagaucgagagcaucuccaagagcaucaaguccgccagcaccaaggaggccaaggacaagaacauccgccggcgccacuaccugacccugaagcgggacuaccucaagggcaaguacgaccgcuucaucugggaggagcccaaggucggguucaagaacucccagauccccgacaccggcaucaucaccaaguacgcgcaggccuaccucaagagcuacuucaagcggguggagagcgugaagggcgggauggucgccgaguuccgcaagcaguggggcauccaggaguccuacaucgacgagaacggguucaagcacuacaaggagaaggaccggagcaagcacacgcaccacaccaucgacgccaucaccaucgccugcaugaccaaggacaaguacgacgugcuggcgcaggccuggacguccgaggacgagcaggacaagcagaaggccaagacccugaugagcgaggccaagccguggaagaccuucaaggaggacaucgagaagaucgaggaggagauccuggugucccacuucacccuggacaacgucaagaagcagagcaagaagaucgugcgcgugcggggcaagaagcaguacgucgccgagaucgagcgcgacgugaacgggaaggcgauggccaagaaggacgccaacggcaagaucaucuacaagcucaacgagaagggggagaagaucccccggcugcagcagggcgacacgauccgcggcucccugcaccaggacagcaucuacggggccaucaagaacccccucaaccaggaggagaucaaguacgugauccggaaggaccuggagucccugaaggcgaacgacgucgacaacaucguggacgagaccgugaagcagaaggucaaggaggccaucgagaacaagauccuccugcugagcuccaacgcccagcagaagaacaagcucguggacgacguguggcugaacaaggagaagcagguccccaucaagaaggugcgcaucuacgccaacagcgugaagaacccgcuggagaucaaggagcagucccuccugagcaagucccggaaggagcacaagcagaaggucuacggccagaacgacgagaacuacgccauggcgaucuacgagcuggacgggaagcgcgaguucgagcucaucaacaacuucaaccuggccaagcugaucaagcagaaggagggcuucuacccccucaacaaggagaaggaggugaaggggaagaaggugcuguaccccaucgccaagagcaacuaccgggacgucgugcugaagcgcggccagcaggucguguucuacgacaaggagguggagaacccgaaggacaucuccgaggugaucgacuucaagggccggaucuacaucaucgaggggcucagcauccagcgcaucguccgccccuccggcaagaucgacgaguacggggugaucaugcugaaguacuucaaggaggcccggaaggccgacgagaucaagaaggacaacuacaagcccgacggcguguucaagcugggggagaaccgccccacccggaagaugaaccacagccaguucaccgcguucgucgagggcaucgacuucaaggugcucccgacgggcaaguucgacaagaucuga

SEQ ID NO: 2224 - RNA, 4377 nt, Artificial Sequence
  Cas9 variant
augaccaagaccauccugggccucgaccuggggacgaacagcaucggcugggcccugaucaaccaggacuucgacaacaagaagggggagauccucggcauggggucccgcaucauccccaugacccaggacaucaaggacgaguucggcaagggcaacagcaucucccagaccgccgagcggacccgccugcgcggggugcggcggcugauccaccgcacgcuccugcggcgcgagcggcugcaccgcguccucaacaucaucggcuuccugccggagcacuacgcgaaccagaucgacuucgagaagcgguucgggaaguucaagcccgagagcgagcccaagaucuccuucgacggcaacgacguguuccuguucgagaaguccuaccaggagaugcucguggacuucaagauccaccagccccagcuggucagcaacgggaagaagaucccgcacgacuggaccaucuacuaccugcgcaagaaggcccucagcaagaagaucgagaaggaggagcuggccuggauccugcucaacuucaaccagaagcggggcuacuaccagcugcgcggcgaggaggaggaggagacccccaacaagcugguggaguuccacucccucaagaucguggaggucaacgccgacgagccccagaaggggaagcccgagaucugguacagccuggugcuggagaacggcuggguguaccggcgcgccuccaagaccccgcuguucgacuggaaggacaagauccgggaguucaucgucacgaccgagaucaacaacgacgggaccgugaagaccgacaaggagggcacggagaagcgcagcuuccgggcgcccaagcccgaggacuggacccugcagaagaagaagaccgaguucgagcuguccaagagcggcaacgaggugggggccuucaucuacgaguccauccuccagaagcccaaccagaagauccgcggcaagcugaucagcaccaucgagcggaaguucuacaaggaggagcugaagacgauccucaagacccagcuguucuuccacaaggagcugaaggacgagaagcucuacaacgccugcaucgaggagcuguacaagaacaacgaggcccaccgcucccugcucagcaacaagggguucgagcaccuguucaucaacgacauccuguucuaccagcgcccgcuccgguccaagaagucccagaucagcaacugcccccuggagaagcgcaccuacaagaaggagggcaucgagaucaccgaggggaucaaggucaucagcaagagcaaccccaucuaccaggaguuccggcuguggcaguggaucuccaaccucagccuguacugcaucgagcccacggagaccaacgugaccuccaccuuccugaacagcaucgaggacuacgagaaccucuucgaguuccugaacaaccgcaaggagaucgagcagaagcaccuccucaaguaccugcuggagaaccagggcuucaagggcaagcugcucacgaacgagcuggagaaguuccgguggaacuucguggcggacaagaaguacccgugcaacgagaccgggucccugcuccacacccgccugagcaaggucaagaacaucucccccgacuuccugaccaaggagaucgagcaccagcucuggcacaucaucuacagcgugacggacaagaucgaguacgagcaggcccugaagaccuucgcccggaagaacaaccuggacguggacuccuucuucgagcacuucaagaagaucccgcccuucgagagcaccuacggcgccuacuccgagaaggccaucaagaagcuccugccccugauccgccucgggaaguacuggaacugggaggcgaucgacagcaucuccaaggaccggaucagcaagauccuguccggcgaguacgacgagaacaucaagaaccgcguccgggagaaggccgugcaccugaccagcgagaacaacuuccaggggcuccaggaguggcuggccaaguacaucguguacgaccgccacuccgagggcaacgaccugggcaaguggacgagcgucagcgaccucgagaccuaccugaaggaguucaagcagcacucccugcggaaccccaucguggagcaggucaucaccgagacccuccgcguggugaaggacaucuggaucaagcacgggaagggcacggagaacuucuucgacgagauccacgucgagcuggggcgggagaugaagaacaacagcgaggaccgcaagcggcugaccaacaccaucaccgagaacgagaacaccaaccuccgcaucaaggcccugcugauggagaugaugaacgacaacgacguggagaacgugcggcccuacucccccagccagcaggagauccucaagaucuacgaggacggcgcccugaacuccaacaucgagcuggacgacgagaucgucaagaucagcaagaaggcggagccgacgaaguccgagcuccagcgcuacaagcuguggcuggagcagaaguaccgcagccccuacaccggccaggugaucccccucaacaagcuguucaccuccgaguacgagaucgagcacguggucccccagagccgguucuucgacgacuccuucagcaacaaggugaucugcgaguccgccgugaacaagcgcaaggacaaccagcuggggcuccaguucaucaagaaccacagcggcgagaaggucgagcugggguucggcaagguggugcaggucuucaccgaggagcaguaccuggacuucgugaaggagcacuacuccaagaaccggagcaagcacaacaagcuccugcuggaggagaucccggagaagaugaucgagcgccagcucaacgacacgcgguacaucuccaaguucgugagcagcauccuguccaacaucguccgcagcgagaaggacgacgacgggcugaacuccaagaacauccuccccggcaacggcaagaucaccaccgagcugaagcgggacugggggcugaacgacguguggaacgaccucauccugccccgcuucgagcggaugaacaccaucacgaacagcgaccuguucaccaccuacaacgacaaguaccagaagcaccucccgaccgugcccuucgaguacuccaagggcuuccagaagaagcgcaucgaccaccggcaccacgccauggacgcccuggucaucgccugcgcgacgcgcgaccaccugaaccucaugaacaaccagagcgccaaguccgagcugaagcgguacgaccugcagaacaagcuccgcaagaaggagcccuacuucaaccagaaggagaacaagcagaaggaggccuucaaggacuucaucaagcccugggggaccuucaccgaggacagcaagaacgcccuggagaagaucaucaucuccuucaagcagaaccugcgggugaucaacaaggccaccaacagcuacgaguccuacaaggacgaggacggcaaccuccgcaucgggaaggacggcaagccggagaagggccugaucaagcagaaggggcugaacugggcgauccggaagccccuccacaaggacacggugagcggccagaucaaccugucccgcaucaagcugcccaacgggaagauccucaccgccacccggaagaaccuggacaccagcuucgaccugaagacgaucgagaacuccaucaccgacaccggcauccagaagauccucaagaacuaccugcugagcaaggagucccccgagcucgccuucagcccggaggggcuggaggagaugaacaacgagaucgagaaguacaacaacggcaaguuccaccaccccaucaacaaggcccgcaucuacgagcugggcuccaaguucaacgucgggcagaccggcaaccggcgcgacaaguucguggaggcggccaaggggacgaaccucuucuucgccaucuaccaggacgagaacaagaaccgcagcuacgagaccaucccccugaacgaggugaucgagcaccagaaguggcgggccagccugcccaaggaggagcaggagaagaucccgcucguccccgugaacaagcugaagggcaccuucaucuucucccugagccccaacgaccucguguacguccccuccaacgacgagcuggagcgcagcgccuccaucgacuucagcaagcugaagaaggagcagaucaaccggcucuacaagaugguguccagcuccgggagccagugcuucuucgugaaguccgaggucgcgaccagcguggugaacaagauggaguacuccagccugaacaagauggagaaguccaucgacaaccugauggucaaggagaucugcaucaagcucaagaucgaccgccugggcaacaucagcaaggccuga

SEQ ID NO: 2225 - RNA, 4377 nt, Artificial Sequence
  Cas9 variant
augaagaagauccugggccucgaccuggggaccaacagcaucggcugggcccugaucgagcaggacuucgaguccaaggccgggaagaucagcggcgcggggucccgcaucauccccaugagccaggacauccucggcaccuucgagacgggccaguccuacagccagaccgccgaccggacccacuaccgcuccauccggcgccuguaccagcggaccaagcugcgccgggagcgccuccaccggagccugaacgugcugggguuccucccggagcacuacaagaacgagaucgacuucgagcagcgcaagggccaguucuaccccaacaaggagcccaagaucgccuacuaccccgagcaggucgccuccaaggugaaguaccaguuccuguucaagagcuccuuccuggagaugguggaggacuucaagcggcgcggguacaacggcgccaucccguacgacuggacgaucuacuaccuccggaagaaggcgcuggagaagaagaucgagaaggaggagcuggccuggcuccugcugaacuucaaccagaagcgcggguacuaccagcuccggggcgaggaggaggacaccaacagcaacaagaaggaggaguucuacgagcugaaggucuccagcguggagcagacccacgacaccucccccagcggcacgugguacaacgugcaccuccagaacgggugggucuaccgccggaaguccaaggacagccugaaggacugggagggccugaacaagaaguucaucgugaccacccaccugaacgccgacggguccgagaagcucgacaaggacggcaacgugagccgcagcuuccgggcccccaaggaggacgacuggggccuggucaagaagcgcaccgaguccgugcuggagaaguccgggcuccacgugggcgaguucaucuacgagagccugcuggagaaccccgagcagaagauccgggggagccucaucaagacgaucgagcgcaaguacuacaagaaggagcuggaggcgauccuggacaagcagaccuccuuccaccgcgagcuccggaacgacgcccuguacaaggaggccacccuggagcucuacccgaagaacagcgcccaccgcuccaacaucaagcagcggggcuucaaguaccuguucaucgaggacaucaucuucuaccagcgcccccucaagagccagaagcaccugaucgcccacugccaguacgagaagcggaccuacaagaacaacgggggcgagacgaucgaggucucccugcagggcgcgcccaagagccaccccuccuuccaggaguuccgcaucuggcaguucaucagcaaccugcgguucuacgacaaggaggagaucguggaggggcaggagguguccaucaccgagaagcuccucaagagcgacuccgacuucgccgagcuguaccacuggcugagccaccagcgcgaggucgaccagaacaagacccugaaguacuucacccagaagaagcugaucccgaagcagaagaaggacaaccccacgauccgguggaacuuccccgaggacaagaaguacgagaugggcgaguucaaggcccagcuccugucccgccuggagaaggugcggaacugccagcccgacaaguuccugacccagaagaacgagcucgaccuguggcacaucaucuacagcgugaccgacaagaccgaguucgagaaggcccuggucacguucgccgagaagcgcgagcucgacuccgagagcuucguggagaacuucaagaaguucccgcccuucaagaacgacuacgcgagcuacucccugaaggccaucaagaagauccugccccucaugcggcgcgggaaguacuggaaggccgagaaccugggcccccagacccugcagcggaucgagaagaucgugaacggggaggccgacgacaagaucagcauccgcgcccggaagcucgcgcugcaccugaacgacaccaaguccuuccagggccucccgaccagccuggccugcuacgucgccuacaaccgccacuccgagaacgaggagaaccagaaguggcagacgcccagcgacaucgacaaguaccugaaggacuucaagcagcacucccuccggaaccccaucguggagcagcugaucaccgaggcccugcgcgugguccgcgacaucuggaagcacuacggccaggggcagaaggacuucuucgacgagauccacguggagcucggccgggagaugaagaaccccgccaucaagcgcaagaagcugagccagaagauccaggagaacgagaacaccaacuaccggaucaaggagguccugcgcaaccucaaggagaacaacaucgacgcgaagccguacucccccagccaccaggagauccugaagaucuacgaggaggggguguaccaguccaucgagaacguggaggacgagaucgagaagauccggaagaacaacacccccagcuccaaggacaucaaccgcuaccggcuguggcucgagcagggcuacaucagccccuacacgggggaggucaucccgcugucccagcuguucagcaaccaguacgagaucgagcacaucaucccccgcucccgguucuucgacgacagccucgccaacaaggugaucugcgagagcuccgugaacgcccugaaggacaacaagaccgcccuggaguucaucaccaaccacggcaacgagaaggucgaguucgcgggcaagaccguggagauccucagcuccgacaaguacacggagcacugcaagcgcuacuucaagcggaaccgcaccaagcugaagaaccugcucagcuacgacgugcccgagggguucaucaaccggcagcugaacgacucccgcuucaucagcaaguacguccggaaccugcucuccaacaucgugcgcgaggaggaggagcgggaggccaucagcaagcacauccugaccaucccgggcuccaucaccagccagcugaagcaggacugggggcucaacgagaaguggaacgagguggucacccaccgcuucgagcggcugaacaaccugacgggcaccaccgacuucggcuucugggacaacaagaucaacgccuuccgcaucaccgugcccaaggagcucuccaagggguucaacaagaagcggaucgaccaccgccaccacacgcuggacgcccuggugaucgccgcgugcaccaaggaccacgucaacuacaucaccagccucaacaccgagcgcaacaaccacucccuggugagcaagcugcggaacacgaagaaggugcucaucaacggcaaggagcgccggaucgccaaggccuacaagcugcccugguccagcuucccccuggacgccaagcaccagcucgagaccaccgucaucuccuucaagcagaaccugcgcgugaucaacaagagcuccaacaagaccuggcaguggcggaacgugaacggggagcagaagaagaagcugaucccgcagacgaagggcgacagcugggccauccgcaagagcaugcacaaggcgaccgucuccgccaagguggagagcguggggaagggcaagaucaagaccaccaaccggacgccccucggcgagaucaagggggagaagcacgucgagaagaucuacgacgcccgcauccgggaggugaucauccccaaccaccugaacaaguaccuggacgagaagggcaagcccaacuacgaggccgccuucucccagagcgggaucaagcagcucaacgagaacaucgaggugcugaacgagggcaagccgcacgcgcccaucuacaaggucccccuguucgaggugggguccaaguuccccgugagcgaggacgccaaguccccgaagaaccagaaguacgucgaggccgacaagggcaccaaccucuucuucgccguguacuggaacgaggagaagcagaagcgcaacuucgagaccgugccccugcaccaggucaucgugcaccagaagcaggucgcgagccugcccaccgagcagcggacguccgugcccaucaagccggagcucggccuguuccuguucagccucucccccaacgaccugguguacgugcccaccgaggaggagaucgagaacccccaccuggucgaccucaagaaccugagcaaggaccagaccaaccgcaucuacaagaugguguccagcaccgggaacgagugccacuucaucccgcaccacaucucccggcugaucaugaaguacaacgccaagcagaaggugggcgaguucgggagccucaacaaggccgagaaggccaucacgggcgagaccaucaaggagaagugccugaagauccagaucaacucccuggggaagcucaagaccgagcgcaucgccuga

SEQ ID NO: 2226 - RNA, 4380 nt, Artificial Sequence
  Cas9 variant
augaaguucaaccugggccucgacaucgggaccaacagcaucggcugggcccuggugaacgaggacuacgagaacaagaaggggaagaucaucgccgcgggcucccgcaucauccccaugacccaggacauccuggacaaguucgggagcggcgccaucacggagacccagaccgcccuccggaccgacuaccgcuccaagcggaagcugauccagcgcuuccugcuccggcgcgagcggcugcaccgcguccugaacgugcucgacuuccugccgaagcacuacgccgagagcaucgacuucgagaaguacuucggcaaguuccugcccaacacggagcccaagcucgccuacaaccagaaccaguucaucuuccagaacuccuuccuggagaugcugaaggaguuccaggagaagcaccccgagcuccugaccaacaacaagaagaucccguacgacuggaccaucuacuaccugcggaagaaggcgcucaaccagcgcaucgagaaggaggagcuggccuggcugcuccugcaguucaaccagaagcggggguacaaccagcugcgcgacgaggaggaggagagcgugcccaacaagcaggucgaguucuacucccucaagaucaucgacgugguggccgaccagcccaaggagggccgggacaagcgcugguacagcaucaaccuggagaacggguggaccuaccggcgcgaguccaagacgccccuguucaacugggagggcaagaccaaggacuucaucgucaccaccgaccucaaccaggacgggagcaucaagaaggacaaggagggcaaggagaagcgguccuuccgcgccccgagcgagggcgacuggacgcugcugaagaagaagaccgagaaggagaucuacgaguccgggaagacccucggcaccuacaucuacgacgcgcugcugaacacgcccgaccucaagaucaagggggacuucauccggaccaucgaccgcagcaucuacaaggaggagcugcagcagaucaucaacaagcagaaggaguaccaccuggagcucaacuccagcaagcuguacaaggccugccuggaggagcucuaccccaagaacgagaucuacaaguccgcccugaagaacaaggacaucgccuaccuguucaucaacgacauccucuacuaccagcggccccugaaggccccgaaguacaacaucggcaagugcaccuacgagagccgcaccuucaagaaggaggacaagaagauccgcgaguacauccccgcgguggccaagucccacccccuguuccaggaguuccggcucuggcaguggaucaagaaccugaagaucuacgagaagcugagcagcgacaacugcacggacuucuuccucaccaacgagcaggacuucgagaaccuguucgaguuccuguggaacaagaaggagaucgaccacaagggcauccuggaguaccucgugaagaccaaguuccccgaccugaagccgaagcaggucaagaccaaggugaaggaguaccgcuggaacuacguguacgaccacgagaaggacgaguccaagacguaccccugcggggagaccuacuuccugcucaagaacaagcuggacaagaucuacaacgcccaggacgacuuccuggacaaggagcggcucuacaaccuguggcacaucaucuacagcgucaccgacaagaagcaguacgagaaggcccuggccaaguucgcgcucaagaaccaccuggacaccaaguccuucgugaacacguucaagcgcaucccgcccuucaagaacgacuacgccaucuacagccugaaggccaucaagaagcuccugccccugaugcgggugggcaaguacuggaacuacgacgacaucgaccccaucaccaagcagaagauccagugcaucaucaccggggaggagaacgacaccaucuccacgcucguccgcgagaagaccaaccacuucagcaacgagaacgacuucaagaaccugccccuguggcucgccggcuacaucguguacaacucccacaacgagagcuccgagaucgagaaguggaaguccccgcaggacaucgacaccuuccugaagaaguucaagcagcacgcccugcggaaccccaucguggagcaggucgugaccgagacgcuccgcgugguccgggacaucuggagcaagaaggggcagggcaagaaggacuucuucaacgagauccacaucgagcugggcaaggaccugaagaaccccguggacaagcgccggaagcucagcuccaccaacaccaagaacgagagcaccaacacccgcaucaaggcgcugcugaucgagcuguucacgcaggggguggagaacgucaagcccaacucccccaagcaccaggagauccucaagaucuucgaggagggcgcccugaacagcgggaucgagaucgaggaggacaucaucaagaucuccaacaccgaccagccgaccaagaagcagcucgagcuguacauccuguggcucgagcacaaguacaagagccccuacaccggccaguccaucccccugagcaagcuguucacgccgaacuacgagaucgagcacaucaucccccggagcaaguacuacgacgacaaccucuccaacaaggugaucugcgagaccgagaucaaccgccugaagaacaaccagcugggguacgaguucaucaacaaccacgagauccgggaggucacccucgaggagggcaagaccauccgccugcugagccccgagcaguacuggaacuucgugacgaccuacuacgccaagaacaaggccaagcgggagaaccuccugcugaaggagcuccccgugcagauggucgagaagcagcugaacgacacccgcuacguguccaaguacgugaugcagcugcucagcaagaucguccggaaggaggacggcaccgacaacgggaucaacuccacgaacauccugagcaucuccggcaagaugacccgcgcccugaagaacgacugggaccucaacgacguguggaacgaccugcugcucuaccgcuucgagcggcugaacaccaucaccaagacgaaccuguucaccaccuacagcgagcagaagcagaagcgcaugccgaucgugcccgaccaguacgcgaagggguuccacaagaagcggcucgaccaccgccaccacgcccuggacgccaucgucaucgccugcaucacccggaaccacaucaacuacaugaacaaccagaacauccagggcgagaagcugaagaagaacgcgaucgagaaggagaacuaccgcgagauccuccagaagucccggcuggacauccgcgcccagcugugcgagaagaaguacaacgacaacgaccccacgaaguacaacuggguguucaucaagcccugggccgacuucaccgagaacaccaaggacauccucgagagcaucaucccguccuucaagcagaaccugcggaucaucaacaagaccgugaacuacuacgagaaguacaacgagaacgggaagaaggucaaggugcgccagaucaagggcgacaacugggccauccggaagccccugcacaaggagacgaucagcggcaaggugcaccucuccuacaagacccccgccaaggggaagauccugaccgcgacccgcaagguccuggacagcuccauggacuucaagagcaucgagaagaucacggacaccggcauccagaagauccucaagaacuaccuggaguacaagaagucccccgagcuggccuucagcccggaggggaucgaggagcucaacgccaccaucaccaaguacaacaacggcuuccaccacaagcccaucuacaaggugcggaucuacgaggagggcgugaaguucccccuggggaacaagggcaacaagaaguccaaguacgucgaggccgagaaggggacgaaccuguucuucgccaucuacaaggaccaggagaacaaccgcuacuucgagaccauccccuucaacgacgugcucgagacccugaagaagggcaugagcgcggugccggagaagaaccaggaggagaacacccuggucuucgcccucagcccccaggaccugguguucgugcccacgcuggacgagaucgagaaccccgacaucgucgacuucaagaaccucaccaaggaccagaccaaccggaucuacaagaugguguccagcuccgggaagcagugcuucuucaucaaggccgagguggccaccagcaucgucaacaagauggaguucuccaccagcaacaagauggagaacuccaucgagggcauccagaucaagagcaacugcuggaagcugaagcuggaccgccucggcacgaucacccgggugaucaaguga

SEQ ID NO: 2227 - RNA, 4383 nt, Artificial Sequence
  Cas9 variant
augaccaaguucaaccugggccucgacaucgggaccaacagcaucggcugggcccuggugaacgaggacugcgagaacaagaaggggaagauccuggccgcgggcucccgcaucauccccaugacgcaggacauccucgacaaguucgggagcggcgccgccaccgagacccagaccgcccugcggacggacuaccgcuccaagcggaagcugauccagcgcuuccuccugcggcgcgagcggcugcaccgcguccucaacgugcuggacuuccugccgaagcacuacgccgagagcaucgacuucgagaaguaccucggcaaguuccugcccaacaccgagcccaagcugguguacaaccagaaccaguucaucuuccagaacuccuucuucgagaugcucaaggaguuccaggagaagcaccccgagcuguuccugaacaaccagaagaucccguacgacuggaccaucuacuaccuccggaagaaggcgcugagccagaagaucgagaaggaggagcuggccuggcuccugcugcaguucaaccagaagcgcggguacaaccagcuccgggacgaggaggaggagaacacccccgacaagcuggucgaguucuacucccugaagaucaucaaggugacggccgacgaggccaaggagggcaucaacaagcgcugguacagcaucaaccucgagaacggguggaucuaccggcgcgaguccaagacgccccuguucaacugggagggcaagaccaagaacuucaucgugaccaccgaccugaaccaggacgggagcaucaagaaggacaaggagggcaaggagaagcgguccuuccgcgcgcccagcgagggcgacuggacccuccugaagaagaagaccgagaaggagaucuacgaguccgggaagacccugggcacguacaucuacgacgcccuccugaacaacccggaccugaagaucaagggggcccucaucaagaccaucgaccggagcaucuacaaggaggagcugcagcagaucaucaacaagcagaaggaguaccacuccgagcugaacaacagcaagcucuacaaggccugccuggaggagcuguaccccaagaacgagaucuacaagaacgagcucaagaacaaggacaucgccuaccuguucaucaacgacauccuguacuaccagcgcccccucaaggcgcccaaguacaacaucggcaagugcuccuacgagagccggaccuucaagaaggaggacaagaagaucaccgaguucaucccggccgucgccaagucccacccccuguuccaggaguuccgccuguggcaguggaucaagaaccucaagaucuacgagaagcugacgaacgacaacuacaccgacuucuuccugaccaacgagcgggacaucgagaagcuguucgacuuccucuggaacaagaaggagaucgaccacaagggcauccuggaguaccugaucaagaccaaguuccccgaccucaagcccaagcaggucaagagcaaggugaaggaguaccgcuggaacuacaucuacgaccacgagaaggacgagagcaagaacuacccgugcggggagacguacuuccugcugaagaacaagcucgacaagaucaccuccauccaggacgacuuccugaacaagaagcgccuggagaaccucuggcacaucaucuacagcgugaccgacaagaagcaguacgagaaggcccuggccaaguucgcgcugaagaaccagcucgacaccaaguccuucgugaacacguucaagcggauccccgccuucaagaacgacuacgccaucuacagccugaaggccaucaagaagcugcucccccugaugcgcgugggcaaguacuggaacuacgacgacaucgaccccaucaccaagcagaagauccagugcaucaucaccggggaggagaacgacaccaucuccacgcugguccgggagaagaccaaccacuucagcaacgagaacgacuucaagaaccucucccuguggcuggccggcuacaucguguacaacagccacaacgaguccagcgagaucgagaaguggaaguccccgcaggacaucgacaccuuccucaagaaguucaagcagcacgcgcugcgcaaccccaucguggagcaggucgugaccgagacgcugcgggugguccgcgacaucuggcucaagaaggggcagggcaagaaggacuucuucaacgagauccacaucgagcugggcaaggaccugaagaaccccguggacaagcggcgcaagaucagcuccaccaacagcaagaacgagaccaccaacauccggaucaaggcccuccugaaggagcugcucaaggaggggaucgagaacaucaagcccaacuccccgaagcagcaggagauccugaagaucuucgaggagggcauccugaacagcgggaucgacaucgaggaggagaucaucaagaucucccagaucgcccagcccaccaagaagcagcuccaguacuaccgcaacuggcuggagcagaaguacaucagccccuacacgggccaguucaucccccuguccaagcuguucaccagcaaguacgagaucgagcacaucaucccgcggagcaaguacuacgacgacucccucagcaacaaggugaucugcgagaccgagaucaaccgccugaagaacaaccagcucggguacgaguucaucaacaaccacgagauccgggagaucacccuggaggagggcaagacgauccgccugcucucccccaagcaguaccuggacuucgucaccaccuacuacggcaagaacaaggccaagcgggagaaccugcuccugaaggagauccccauccagaugaucgagaaccagcugaacgacacccgcuacgugagcaaguacgugaugcagcuccuguccaagaucguccggaaggaggacgggacggacaacggcaccaacagcaucaacauccuguccgugagcgggaagaucacccgcguccucaagaccgacuggggccugaacgacguguggaacgaccugcucugcuaccgguucgagcgccugaacaagaucacgaacaccaaccuguucaccaccuacuccgagcagaagcagaagaucaucccgaucgugcccgaccaguacgccaagggguuccacaagaagaagcucgaccaccgccaccacgcgcuggacgccauccugaucgccugcaucacgcggaaccacaucaacuacaugaacaaccagaacauccagggcgagaagcucaagaacuucaagaucgacaagcacaacuaccacgagaucuuccagaagucccgccuggacaugcgggcccagcugugcgagaagaaguacaacgaccacgacagcaccaaguacaccugggucuucaccaagcccugggcggacuucacggagaacaucaaggacacccucgaguucaucauccccagcuucaagcagaaccugcgcaucaucaacaagaccgugaacuacuacgagaaguacaacgagaacggcaagaaggugaagguccggcagaccaagggggacaacugggccauccgcaagccgcugcacaaggagacgaucuccggcaaggugcaccuccuguacaagacccccgccaaggggaagauccugaccgccacccggaaggugcucgacagcuccauggacuucaagagcaucgagaagaucacggacaccggcauccagaagauccugaagaacuaccugaaguacaaggagucccccgagcucgccuucagccccgagggcaucgaggagcugaacaucaccaucgcgaaguacaacgacggguucuaccacaagccgaucuacaagguccgcaucuacgaggagggcgugaaguucccccuggggaaccggggcaacaagaagaacaaguacguggaggccgagaaggggaccaaccucuucuucgccaucuacaaggaccaggagaacaaccgcuacuucgagacgauccccuucaacgacguccuggagacccugaagaagggcaugagcgccgugcccgagaagaaccaggagaagaacacccucguguucgcccuguccccgcaggaccuggucuucgugcccacccucgacgagaucgagaaccccgacaucguggacuuccggaaccugacgaaggaccagaccaaccgcaucuacaagauggucagcuccagcggcaagcagugcuucuucaucaaggcggagguggccaccuccaucgugaacaagauggaguucaccaccagcaacaagauggagaacuccaucgaggggauccagaucaagagcaacugcuggaagcugaagcucgaccggcugggcacgaucacccgcgucaucaaguga

SEQ ID NO: 2228 - RNA, 4389 nt, Artificial Sequence
  Cas9 variant
augaccaagaacauccugggccucgaccuggggaccaacagcaucggcugggcccugaucaagcagaacuucgagaacaagcagggggagauccucggcauggggucccgcaucauccccaugagccaggacauccugggcgacuucggcaaggggaacuccgugagccagacggccgagcggaccaaguaccgcuccguccggcgccugcgggagcgcuuccuccugcggcgcgagcggcugcaccgcgugcucaaccugcugaacuuccucccgcagcacuacgcgagccagaucgacuucgagaagcgguucggcaaguucaagguggagaccgagcccaagcuggccuggaagaacaucgacgggcaguucuccuuccuguuccagaccagcuucaacgagaugcucgaggacuuccgcgucaacggccaggacgugaagauccccuacgacuggacgaucuacuaccugcggaagaaggcccuguccaagaagaucgagaaggaggagcucgccuggauccugcugaacuucaaccagaagcgcggguacuaccagcuccggggcgaggaggaggaggagaaccccaacaagcugguggaguucuacagccugaaggucguggacguggucgccgacgagccgcagaagggcaaguucgacaucugguacucccucauccuggagaacggguggguguaccgccggagcuccaagaucccccuguucgacuggaaggacaagacccgcgacuucaucgugaccaccgaccucaacgacgacggcagcaucaagaaggacaaggacgggaacgagaagcgguccuuccgcgcgcccagcgagaacgacuggacgcuggucaagaagaagaccgagcaggagaucgagcagucccggaagaccgugggcaccuacaucuacgaggcccugcucgacaaccccaagcagaagaucaagggcaagcuggugcgcacgaucgagcgcaaguucuacaaggaggagcugcggcagauccucgagaagcagaaggaguuccaccaggagcugcagagcgacgaccuguacaacgacugcguccgcgagcucuaccggaacaacgaggcccaccagcugacccuguccaagaaggacuucgugcaccuccugauggacgaccugaucuucuaccagcgcccgcuccggagccagaaguccagcgugagcaacugcacccuggaguuccgcaaguacaaggacgagaacggggccgagcacacccaguaccugaaggcgauccccaaguccaaccccuacuaccaggaguuccggcucuggcaguggaucuacaaccugaacaucuaccgccgggaggacgagcagaaccccaucacgggcgaguuccugagcaccaccaaggaguucgagaaccucuucgaguuccugaacacccgcaaggaggucgaccagaaggcccugcugaagcacuucaagcucaacgacaagacgcaccgguggaacuucguggaggacaagaaguacccgugcaacgagaccaagaccaugaucuccagccgccuggagaagguggagaacaucuccgacgacuuccugacccgggagaucgagcagaagaucuggcacaucaucuacagcgucaacgacaagaucgaguacgagaaggcccucaaguccuucgccaagaagcaccaccuggacgagagcuccuucuucgaggccuuccgcaaguucccgcccuucaagagcgaguacggguccuucagcgagaaggcggugaagaagcugcucccccugaugcggcugggcaaguacuggaacuacgccgacaucgacaaguccagcaaggagcgcauccagaagaucaucuccggggaguacgacgagaacaucaaggaccgggugcgcgagaaguccguccaccucacgaccgagaacgacuuccagggccugcagcuguggcucgcccaguacaucguguacggccggcacagcgaggccagcaugaucgggaaguggaacagcgccgacgaccuggaggaguuccugaagaacuucaagcagcacucccuccgcaaccccaucgucgagcaggucaucaccgagacccugcgcguggugaaggacaucuggcugaaguacggcaacggggcgaaggacuucuucaacgagauccacaucgagcucggccgggagaugaagcugcccgccaaggagcgcgaggaccugacgcggaagaucaccgagaacgagaacaccaaccuccgcaucaaggcccugcuggccgagaugaugaacgacagcuccguggagaacgugcggcccuucagccccaugcagcaggagauccucaagaucuacgaggacgggguccugaacuccggcaucgagaucgaggacgaguaccugaagaucagcaagaccgcccagccgucccccagcgaccucaagcgcuacaagcuguggcuggagcagaaguacaagucccccuacacgggccagaucaucccccucaacaagcuguucaccccggaguacgagaucgagcacaucaucccccagagccgguacuucgacgacuccuucagcaacaagaucaucugcgaguccgcggugaacaagcugaaggacaacuacaucgggcucggcuucaucaagcaguucgggggcaccaucaucgagcugggguucggcaagagcgugaaggucuucgagaccgaggaguacgaggacuucgugaagaagcacuacgccaacaaccgcuccaagcggaacaagcugcuccuggaggacauccccgagaagaugaucgagcgccagaucaacgacacgcggcacaucagcaaguacaucuccggcgugcugagcaacaucguccgcaucgacgacgaccaggccaagaagaucaucgaggacgccgagauccucgcccggaaggagaucgacaaggacaaggcgaacgagauccgccggaaggccaagagccuggccaccgacgacgggaucaacuccaagaacaucgugcccggcaacgggaagaucaccacccagcugaagcaggacuggggccucaacgacguguggaacgaccugauccugccgcgcuucgagcggaugaaccagcucaccaacagcaaggacuucacggucuggaacgagaaccaccagaaguaccugcccaccgugcccaucgaguucuccaagggcuucagcaagaagcgcaucgaccaccggcaccacgcccuggacgcgcucgugaucgccugcgccaccaaggaccacgucaaccugcugaacaaccaguccgccaagagcgacaccaagcgcuacgaccucaagaagaagcugaugaaguucgagaaggugguguaccaccacacgcagaccgggaacaagaucgagcgggagaucccgaagcaguuccugaagcccugggagaacuucaccuucgacgccaaguacaaccucgaguccaucaucgucagcuucaagcagaaccugcgcgugaucaacaaggcgaccaacuacuacgagaaguacguggagaaggacggcacgaagaacaaggggcgcgucgagcagaccggcaccaacugggccauccggaagcccaugcacaaggacaccguguccgggaaggugaaccugcccugggucaaggugccgaagggcaagauccucacggccacccgcaagauccuggacaccagcuucgaccugaaguccaucggcagcaucaccgacacggggauccagaagauccuccggaacuaccuggaguucaagggcucccccgagcuggccuucagccccgaggggaucgaggaccucaacaagaacaucgagaaguacaacgacggcaagccccaccagccgaucaacaaggugcgcgucuucgagcugggguccaaguuccaggugggccagaccggcaacaagaaggacaaguacguggaggccgcgaaggggaccaaccuguucuucgccgucuacgaggacaagaacggcaagcggagcuacgagaccaucccccucaacgaggugaucgagcgccagaagcaggggcuguccguggucgaccugaagggcacgaacgacuucuaccucugccccaacgaccugguguacauccccagcgacgacgagcuggagaacaucaacaacaucgacuucaagaacaucgccaaggagaagaacgagcggaucuacaagguggucuccuucagcgggagccagaucuucuucgugcgccaggacaucgccaccuccaucgugaacaaggccgagcucagcacccugaacaagauggagcgggcgauggacggcuccaugaucaaggagagcugcgucaagcugaacguggaccgccucggcaacaucuccaaggccuga

SEQ ID NO: 2229 - RNA, 4401 nt, Artificial Sequence
  Cas9 variant
augaccaagaacauccugggccucgaccuggggaccaacagcaucggcugggcccugaucaagcaggacuucgagaacaagcagggggagauccucggcauggggucccgcaucauccccaugagccaggacgugcugggcgaguucggcaaggggaacuccgucagccagacggccgcgcggaccgacuaccgcggcgugcggcgccugcggaagcgcuuccuccugcggcgcgagcggcugcaccgcgugcucaacguccugaacuuccugccggugcacuacgccucccagaucgacuucgagaagcgguucgggaaguucaaggaggacaccgagcccaagcucgccuacaacaaggagggcuucaucuucaagaacagcuucgaggagaugguggccgacuuccgcaagcaccagccccagcugcuggagaacgacaagaagauccccuacgacuggaccaucuacuaccuccggaagaaggcccuguccaagaagaucgagaaggaggagcuggcguggauccuccugaacuucaaccagaagcgcggguacuaccagcugcggggcgaggaggaggaggagaacccgaacaagcucgucgaguucuacagccugaagaucacggacgugcuggccgacgagccccagaagggcaaguccgacaucugguacagccucauccuggagaacggguggaucuaccgccgguccagcaagacgccccuguucgacuggaaggagaagacccgcgacuucaucgugaccaccgaccucaacgacgacggcuccaucaagaccgacaaggacgggaacgagaagcggagcuuccgcgcccccuccgagaacgacuggacccuggucaagaagaagaccgagcaggagaucgacaagagccagaagacggugggcaccuacaucuacgagacccugcuccagaacccgaagcagaagaucaagggcaagcuggugugcaccaucgagcggaaguucuacaaggaggagcugaagcagauccucgagaagcagaaggaguuccaccaggagcugcagaacgacgaccuguacuccgacugcguccacgagcucuaccgcacgaacgaggcccaccagcugacccugagcaagaaggagaucgugaaccucuucauggaggaccugaucuucuaccagcgcccccugcggucccagaagaccagcaucagcaacugcacccucgaguuccgcaaguacaaggacgagaacgggguggagcacacgcaguuccugaaggcgauccccaaguccaaccccuacuaccaggaguuccggaucuggcaguggaucuucaaccugaacaucuacaagcgcgacgacgacagcaacgucaccaaggaguuccucaacaccaccgaggacuucgagaaccuguucgaguuccugaacaaccggaaggagguggagcagaaggcccuccugaagcacuucaagcugaacgagaagcugcaccgcuggaacuucguggaggacaagaaguacccgugcaacgagacgaagaccaugaucuccacccggcucgacaaggucgagaacaucagcaaggacuucuucacccgcgagaucgagcagaagaucuggcacaucaucuacuccgugaacgacaagaucgaguacgagaaggcccugaaguccuucgccaucaagcacaaccuggacgagaacuccuucuucgaggccuucaagaaguucccgcccuucaagagcgaguacggcuccuucagcgagaaggcgaucaagaagcuccugccccugaugcggcucgggaaguacuggaacgaggacgagauccugaaguacuccgacgacuacuucaagaacaucgagagccugcucggcgugcugaagcagcgcgacgagaacaucuccgacgccgaccgggagaacuacaacaagacgaucaacaacaagcugcgcgccgagcucgagaacuuccagaacgccgagaucgagagcuuccaggggcugcggcugcacaucgcccaguacauccucuacggcaagcacuccgagggcgacaacaagaaguucaacagcgcggacgaccuggagaaguuccugaaggaguucaagcagcacucccuccgcaaccccaucgucgagcaggucaucaccgagacccugcggguggugaaggacaucuggaccaaguacgggaacggcgccaaggacuucuucgacgagauccacaucgagcuggggcgcgacaugaagaagacgcgggacgagcgcgccgacgccaccaagaucaucaccgagaacgagaacaccaaccuccggaucaaggcccugcuggcggagaugaugaacgacguggagauggagaacguccgccccuacagccccaugcagcaggagauccucaagaucuacgaggacggcauccugaaguccgacaucgagaucgaggacgacauccugaagaucagcaagacggcccagcccagcuccagcgaccucaagcgcuacaagcuguggcuggagcagaaguacaaguccccguacaccgggcagaucaucccccucaacaagcuguucacccccgaguacgagaucgagcacaucaucccccagagccgguacuucgacgacuccuucagcaacaagaucaucugcgaguccgccgugaacaagcugaaggacaacuacaucggccucggcuucaucaagcaguucgggggcaccaucguggagugcggguucggcaagaacgucaagguguucgaggccgaggaguacgaggacuucgugaagaagcacuacgccaacaaccgcgggaagcggaacaagcugcugcucgaggagaucccggagaagaugaucgagcgccagaugaacgacacccggcacaucagcaaguacaucuccggcguccugagcaacaucgugcgcguggaggacggcuccgacgagggggucaacagcaagaacaucgugcccggcaacgggaagaucacgacccagcugaagcaggacuggggccucaacgacguguggaacgagcugauccugccccgguucgagcgcaugaaccagcucaccaacuccaccgacuucacggcguggaacgagaaccaccagaaguuccugcccaccgucccgaucgaguucagcaagggcuucuccaagaagcggaucgaccaccgccaccacgcccuggacgcccucaucaucgccugcgcgaccaaggaccacgugaaccugcugaacaaccagagcgccaaguccgacaccaagcgguacgaccucaagaagaagcugaugaaguucgagaagguggucuacaaccacccccagacgggggaccgcaucgagcgggaggugcccaagcaguuccugaagccgugggacaacuucaccuucgaggccaagaacaaccucgacaagaucaucgugagcuucaagcagaaccugcgcgucaucaacaaggccaccaacuacuacgagaaguucguggagaaggacggcgugaagaccaaggagcgggucgagcagaaggggacgaacugggccauccgcaagagccugcacgaggagaccguguccggcaagaucgaccuccccuggguggagaccaacaacggggaguucaucaccgcgacgcgcaagagccuggacgccuccuucaaccuggagaagaucaagaagaucaccgacaccggcauccagaagauccuccggaacuaccugaaggccaaggacgacaacgccgagcuggccuucagccccgagggcaucgaggaccucaacaagaacaucgagaaguacaacgacgggaagucccaccagcccaucguccgggugcgcguguacgagaagggcaaggggcgguucgcgcugggccagaccgggaacaacaucgacaaguacguccagggcagcccgaaccuguucuucgccaucuacaaggacgagaacggcaagaaguccuacgagagcauccgccucgacaucgugaucgagcgcaugaagcaggggcugcaggccgugcccgagacgaaccccaacggcaucucccuguaccagaaccucagcccccuggaccuggucuacaucccgaccgaggacgagaucgagagcccccaccucaucgacuucaccauccugaacaagacccggcuggagcgcaucuacaacgugaacgacuucagcggguacacgaucuacuucucccagaacagcuucgccaagaacaucuaccccaaggagauggacaugaccuggaacgagaagaagcagaagcccuccggcagcuucgacuccaagaccgccagcuacaacaagaaguccaucaaggacaucuucaucaagcucaagaucgaccggcuggggaacaucagcaaggugagcaacacccuguga

SEQ ID NO: 2230 - RNA, 4401 nt, Artificial Sequence
  Cas9 variant
augaagaacauccugggccucgaccuggggaccaacagcaucggcugggcccuggugaaggaggacuucgagaacaagcagggggagauccucggccuggggucccgcaucauccccaugagccaggacauccugggcgaguucggccgggggaacuccaucagccagaccgccgaccgcaccggcuaccgcgggguccggcggcuccgcgagcggcaccuccugcgccgggagcgccuccaccgggugcugaacauccugggcuuccucccgaaccacuacgcgaaggagaucgacuucaccaagcgccuggggaaguucaucaaccacgccgagcccaagcuguccuucgacaaggaguucaucuucaaggacagcuucaacgagaugcucaaggacuuccagcagaaccagcccggcuucaucaucaacaagcacggcgaggaggcccuggugcccuacgacuggaccaucuacuaccugcggaagaaggcccucacccagaagaucgacaaggaggagcuggccuggauccugcucaacuucaaccagaagcgcggguacuaccagcugcggggcgaggaggaggaggagaacacgaacaagcuggucgaguucuacucccucaagaucaucgacgugaucgcggacaacgaggugaacaagaagggggaggucugguacagccugcaccuggagaacggcuggaucuaccgccgguccagcaagaucucccucguggacuggaaggacaaggugcgcgacuucaucgucaccaccgacgugaacgacgacggcagcgagaagcuggacaaggacgggguggucaagcgguccuuccgcgccccgagcgccgacgacuggacccugcucaagaagaagacggagcaggacaucgacaacuccaacaagaccgugggcgccuacaucuacgagaaccugcugcucaaccccaagcagaagaucaaggggaagcuggugcggaccaucgagcgcaaguucuacaaggacgagcugaagcagauccucgagaagcagaaggaguuccaccaggagcugcagaacgagcagcugcuccaggacugcguccgcgagcuguacaaguacaacgagcagcaccagcagaugcuggagagcaaggacuucgugcaccucuuccugaacgacaucaucuucuaccagcggccccugcgcucccagaagucccucaucuccaacugcacccuggagaagcgggugagccgcgacggcgucguguuccccaucaaggugaucagcaaguccaacccguacuaccaggaguuccggcugcuccaguggcugcagaaccuggcgaucuaccgcaaggacgacgacgucaacgugacgcaggaguuccugaacagcaucgaguccugggagaaccuccugcaguuccugaacgccaagaaggagaucaagcaggagcagcucaucaaguuccugcuggagcagaaggggcucaagggcaacagccugaagaccgccauccugaccuaccgguggaacuacgugaccgacaaggucuaccccaugaacgagacgcgcucccucauccaggacaagcugaagaagguggagaacgucgccaccgacuuccugagcuucgacaacgagauggcccucuggcacaucaucuacuccgugaacgacaagaucgaguacgagaaggcgcuggccaaguucgccagcaagcacaaccuggacgagaucuccuucguggagagcuucaagaaguucccgcccuucaaguccgacuacggcagcuucuccgagaaggccaucaagaagcuccugccccugaugcgguucgggagcgucuggaacaagaacaacaucgugcccuccgugcucgaccgcaucgacaagauccugaccggcgaguacgacgagaagaucaagauccggguccgcgagaaggccgagcaguuccagcugaaccagaucgaggacuuccagaaccucccccuguggcuggcgcaguacgugguguacgaccggcacagcgaggccgagaucgccgggaaguggaacuccgucaaggaccucgagaacuaccugaaggaguucaagcagcacagccugcgcaaccccaucguggagcagaucaucaccgagacgcuccggguggucaaggacaucuggcagcaguacggcaacggggugcagaacuucuucgacgagauccacaucgagcugggccgcgagaugaagaacaccgccgacgagcggaagcgcaucaccaacuccgugaccgagaacgagaacacgaaccugcggaucaaggcccuccuggucgagcugaaggaggacaccaacaucgagaacgugcgcccgcacagccccaugcagcaggagauccucaagaucuacgaggagggcgugcugaacgcggucgagaacaucgacgaggacauccugaagaucagcaagaccgcccagcccuccaagagcgagcucauccgcuacaagcuguggcuggagcagaaguaccagucccccuacaccggggagaugaucccgcucagccggcuguucacguccgacuacgagaucgagcacgugaucccccagagccgcuacuucgacgacucccugagcaacaaggugaucugcgaggccgccgucaacaagcggaaggacaaccagcucggccuggaguucaucaagaaccaccacuccgagaagaucgagcuggggaacggccgcaccgcccaggugcucgagguggaggcguacgagagcuucgucaagaagaacuacgacaagaaccgggggaagcgcaacaagcugcugcucgaggacgugcccgagaagaugaucgagcggcagcugaacgacacccgcuacaucuccaaguucgugacccaccuccugagcaacaucguccggaaggacgaggugaacuccaaggacgacggcaucaacagcaagaacaucauccccggcaacgggaagaucacgucccagcugaagcaggacuggggccugaacgacguguggaacgagcucauccugccgcgcuucgagcggaugaacaaccugaccaacagcaccgacuucaccuccacgaacaccaacgggaagaucauccccaccgucccccucgaguacagcaagggcuucagcaagaagcgcaucgaccaccggcaccacgcccuggacgcccuggugaucgcccucgcgacccgcgaccacgugaaccugcugaacaacgaguccgcccuccccaagaaggaccggaccaaggaggagcagaaguccuuccgcuucgaccugcaggucaaccugcggaacaaggagaaguacuucaacgugaaggagggccgcgagaaggagaaguucacgaccuucaagaagccguggaacacccucacccaggacacgcgggacgcccuggagaacaugguggucagcuucaagcagaaccugcgcgugaucaacaaggccaccaacuacuacgagagcuacaccgacgagaacgggaaccuccggcuggacaaguacggcaaccccaagaaggagcugaucucccagaaggggaccaacugggccauccgcaagagccuccacaaggagacgguguccggccagauccaccuggaccgcgucaaggugaccaaggggaagaucgugaccgcgacccgcaagagccuggacuccagcuucaacgagaaguccaucgagagcaucacggacaccggcauccagaagauccuccggaacuaccugaaggccaaggacaacaagcccgacgucgccuucuccccggagggcaucgaggagcugaacaagagcaucuccguguacaacgaggggaagaaccaccagcccaucaucaaggugcggaucuucgagcagggcagcaaguuccccgucggggagaccggcaacaagaucgccaaguucguggaggccgcgaaggggaccaaccucuucuucggcaucuaccaggacaagacgggcaagcgcuccuacgacaccaucccccugaaccuggugaucgagcggcucaagcaggggcugagcccgguccccgagaccaacgagaagggccaccagcugcuguuccaccugucccccaacgaccugguguacgugcccaccaucgacgacaacgagcagcucgacagcaaccgcgucuacaaguucacggacagcuccgacacgaccugcaacuucaucccgagcaacaucuccgccaucaucuucaacaucaacagcaaggagcaggagaagcgggggaucaacuaccccauccagaacgagcugggcguggggagcccccagagcaagaaccagaaguccuucgacggcuucaugaucaaggaggucugcaucaagcugaagguggaccgccucggcaacaucagcaagaccuga

SEQ ID NO: 2231 - RNA, 4416 nt, Artificial Sequence
  Cas9 variant
augugcaaguacuucuacaucaagaacuucaucaccuucgugcugagcaaguccaucauccccaugaagcacauccucggccuggaccuggggagcaacuccaucggcugggccuucguccagcaggacuucgagaacaagcaggggaagaucaucgccaccggcagccgcaucaucccgauggaccaggggauccucggcgacuucgagcggggcaacacggugucccagaccgcggagcgcaccaccuaccggagcacgcgccggcugcgcgagcggcaccuccuccgccgggagcgccugcaccgggugcugcacauccucggguuccugccgccccacuacgacgcccagaucgacuucaccaagcgcuacggcaaguucaucgacaacgccgagcccaagaucgccuacaacaacgggaacuucaucuucaugaacuccuucaacgagaugaucgaggacuucaagaagcaccagccccagcuguucuacaagaaguccaacggcgaggagagcaagauccccuacgacuggaccaucuacuaccuccggaagaaggcccugagccagaagaucacccagcaggagcuggcguggcucauccugcacuucaaccagaagcgcggguacuaccagcugcggggcgaggaggagacggagaaccccaacaaggaggucgccuuccacucccucaaggugguggacgucgaggccgaggcccccaacaagaagggcgagaucugguacaccauccgccuggagaacggguggaucuaccggcgcaccagcaagaucccgcuggacgacuggaagggcaagacccgggacuucaucgugacgaccgaccucaacgacgacgggaccaucaagguggacaaggagggcaaggagaagcgcuccuuccgggcgcccgacgagaacgacuggaaccugcugaagaagaagaccgagcacgacaucgacuucagcggcaagacggucggggccuacaucuacgaccaccuccugcagaaccccaaccagaagaucaagggcaagcuggugcgcaccaucgagcgcaaguacuacaaggacgagcucaaggccauccuggccaagcagaucgcccugcagcccgagcuguucaccgagacccugcuggcggacugcauccgggagcucuaccgcaagaacgagacgcagcagcagaaccugcuguccaaggacuuccuccaccuguucguggaggacaucaucuucuaccagcggccgcugcgcagcaagaaguccaccaucgccaacugcacccucgagaagcggagcuacaucgacaaggagaccaacgagcgcaaggacgcccccaucaaggucugcgccaaguccaaccccuacuaccaggaguuccgggugcugcaguggcugcagaaccuccgcaucuacgagaucgagacggaccgggaggugaccgccgaguucaucgagacgccccaggacugcgaggcgcuguucaacuuccugaugagccagaaggagaucgacaacaaggggcuccugaaguacuuccuguucgccaagaacccgcagaucaaggacaaggccgccaagagcgagcucaagaaguggcugaccaccuaccgcuggaacuacgucuacgacgccgcggacaacuccagcaagaaguaccccaugaacgagaccggcuacgagcugcagcgguaccugcagaagguggaggggcuccccgccaacuuccugaccuucgacaucaccuaccagcuguggcaccuccuguacuccgugaaggacaaggucgaguucgagaaggcccugaagaaguucgccaagaagaagcagcucgacaagacgagcuucguggacuccuucaagaacuucaagcccuacccgaacgaguacggcagcuucuccgagaaggccaucaagaagcugcugccccucaugcgcuucggcaaccacugggacuucaaccggaucgacgugagcacccagaagcgcaucgacgaccugaucaacggggucgcgaacgaggacauccggaccaucauccgcgagaaggccgagaaguaccagcugaacuccgagaccugcuuccaggaccucccccuguggcuggcccaguacgugguguacaaccggcacgccgaggcgacggacaucgagaaguggaccagcgucuccgaccucgaggccuaccuggaggacuucaagcagcacagccugcgcaaccccaucguggagcaggucgugaccgagacccuccgggugguccgcgacaucuggcagcaguacggcgggggccaggccaacuucuucgacgagauccacaucgagcuggggcgcgagcugaagaagaccgccgaggagcggaagcagcucuccgacaagaaccaggagaacgagagcacgaaccugcgcaucaagaagcugcucgccgagcugaaggaggacgcguccauccagaacgugcggccguacagccuggugcagcaggagcuccugaagaucuacgaggagggcgucuucuccgccaccgacgagguggaggaggacauccagaagauccgcaagaaggccgagcccagcaaggccgaccugcagcgguacaagcucuggcuggagcagaaguacaagucccccuacaccggcgaggugaucagccugaccaagcuguucacggaggaguacgagaucgagcacaucaucccccagagccgcuacuacgacgacucccucagcaacaaggucaucugcgaguccgccgugaacaagcugaagaccaaccagcucgggcuggaguucauccagaaccaccacggcgagaaggugcggaucaccgcgaacaaggaggucaccaucuucacggaggagcaguacaaggaguucgugaagaagcacuacgccaacaacagcgccaagcagcagaagcugcuccugaacgagaucccggagaagaugguggcccgccagcugaacgacacccgguacaucuccaaguacaucagcgagauccucuccaagaucguccgcagcgacgagaaggacgagggggugaacuccaagaacaucauccccugcaccggcaagaucaccacggcccugaagcaggacugggggcugaacgacguguggaacaagcucauccugccccgguucgagcgcaugaaccagcugacccagacccagcuguucaccagcuacaacgaccggcuccagaagaaccugccgacgguccccaucgaguacucccagggcuuccagaagaagcgcaucgaccaccggcaccacgcgauggacgcccucgugaucgccugcgccacccgcgagcacaucaacuacaugaacaaccagcacgcgcuggacaagagcaaggacaagaaggagaagcagcagucccggaucgaccugcgcaccauccucugcgagaagaagaacaacaacuggcaguucaagaagcccuggagcaccuucacgcaggaggccaaggaggcccuggagcacaucguggucuccuucaagcagaaccugcgggugaucaacaaggccaccaacuacuacgagaagugggaggagaagaacggcgugcucgucaagaagaaggugaagcaggaggggaccaacugggccauccgcaagccccugcacaaggagaccgugagcggcaagaucguccuggaccggaagaucgggaaggacaagauccucacggcgacccgcaaggccguggacaucaccuucaccgagaagaucaucuccagcaucacggacaccggcauccagaagauccugcugaacuaccucaaguacaagggcagcccggagguggccuucuccaccgaggggcuggaggagcugaacaagaacaucgcccaguacaacaacggcaagaagcaccagcccaucuacaagguccgcaucuucgaggaggggagcaaguucccccucggcgagaccggggccaaggcgacgaaguacguggaggccgccaagggcaccaaccuguucuucggcguguaccaggggaagggcaagcggaccuacgccaccaucccccugaacgaggucaucgagcgccagaagcaggggcucccguccgugcccgagcggaacgagaagggcgagccccugcuguucagccucucccccaacgaccugguguacgucccgauggagggggagaucgccgagacgaucgacuucaacaaccugagcaaggagcagaaggagcgcaucuacaagaccguguccuucaccggcaaccagugcuucuucgugcaggaggcggucgccacccccaucgugaacaagauggaguacagcccccucaacaagauggagcgggacauccugggcaccaugaucaaggaggugugcaucaagcugaaggucgaccgccucgggaacaucacgaaggccuga

SEQ ID NO: 2232 - RNA, 4416 nt, Artificial Sequence
  Cas9 variant
augggcuacaaggcgccccgcaacgacaagggggagaucgacuacggcguggggcuggaccucggcaacgggagcgucggcuggguggccauggacaaggacuaccaccugauccgggcccgcggccacgagcugaucggggcccggcuguucgacccggccaacuccgccgagaaccgccgggagagccgcaccacccggcgccggcugucccgccggcgcuggcggcugcgcaugcucgacagccuguucgccuccgagcuggcgaagaucgaccccaacuuccucgcccggcgcaaguacagcugggugcaccccaaggacgagcagaaccacgagaacugguacggcuccaucaucuucgggagcaaggagcaggacaagcaguucuacaaggacuaccccacgaucuaccaccuccggaagaagcugaccgaggacaccgagcgccacgacauccgggagaucuacgucgccauccaccacaucgugaaguaccgcggccacuuccuccgggagggggagaucaacuccgagaaccuguucgacccggagggcuucguggagcugaucaaggacgucaucaagcucaacaacagcuacgacgaguccacccccaucuucgaggccagccccgcggacguguccgaggcccugcugaacgagcacacgagccgcuccggccgcaucgaggacacccucgacaagcuggacuucagcgugucccgggucgacaagcacgagcugaaggggaugcgcgacgccgccaaggccgugaucggcgcgaucguggggaacaccgccgacuucagcaagaucuucaaccucgacaaccuggacaaggacuccaaggacaaccugaagcucaaguucgccgacagcaacuucgacgagaaguacggcggcgucguggggagcggccugcuggacgagacccagaucgagcucguggaccggauccacgccgucuacgacgccguggcgcugaaggggauccugggcgacgcccacacgaucuccgaggccaagguggagagcuacgagaagcaccgcaagaacuggaagcucaucaaggaggagcugcggaccaaggagaacaaggacgaggucgaccugugguacggggaccucuccggccgccaguacaagaacccgcccgaccccgagaagggccccgacgaggggagcaagaaggacucccccauccgggacagcgaccagaagcagaaccugaucaagaaggccaacgacuacuucaccgagcugaucgacgacucccagcucagcgaggagcagaagaacugccugaagaacgacaucaacaacggccagcuguucccggugcagcgcuccagcgacaacggggugauccccuaccagauccaccucaacgagcugcggcgcaucaucgagaaccagaagcaguacuaccccuuccuggccgagaccuucauccggaagacggcggagggcaaguccuacgaggagaacaagaucgucgcccuccugaaguuccgcgugcccuacuacguggggccgcuggucagcaaggaggacauggaggagcacuccagcggcaacuccgccuaccacuggauggcccggaaccccggccgcggggaggccaucacccccuggaacuucgacgagguggucgacaaggacgagagcggcgcgcgguucaucucccgccucaccgggaccgacacguaccugcugggcgagcccacccucccgcagcacagccugcuguacgaggaguacauggugcuguccgagcucaacaacgugcggcugaacguccgccaggggaaccacuggagcgacaagaaccggcagcgccugagcuacaagcagaaggaguuccucaucgagaaccuguucaaggagcacaagaccgugacccgcaagcgggccgaggacugccuguccagcaugggcugcggcgaggugcagcuguucgggcuguccgacgagaagaaguucgccagcucccugagcuccuacaucacgcucaagaagauccugggcaaggccuucgucgacgacagcgggaacuccgcgauccuggagcgcaucaucgaggugcagaccguguucgaggaccgggagccccucacccaccagcugagccugaucgacucccucaccgucgagcagcgcaagcagcuggccaagauccacuacacgggcuggggcaagcugagccggaagcuccugaccuccaagaaggggagcuacaagauccacucccagaacgagaucaugcgcacccagcacagcaucaucgacaucaugcggggcgacucccugaaccucaucgagaucauccgcgacaagaagaucgggaucggcgaguggaucgacaacgagaaccuggaccgggagaccggggagagcgacgugagccgccuggaguccguguucgagggcaucgucaugagcccccgggugaagcgcggcgugguccaggccgugcgggugaucgacgaccucgccaaggccaucgggaacccgccccagcgcaucuucaucgagauggcggacgagguccaggccucccagcggacggugagccgccugucccggcugaaggcccucuacggcagccccucccugcagaaggaguucaacgaccugaaggaccuccgcaagagccugaacgagaccaaggacgccgaccugcaggaggaccggcucuaccuguacuacauccagcuggggaaggaccucuacaccggcaaggagaucuccaucgacagccuguccagcgccuacgacaucgaccacaucgugccccaggcgcugacccaggacgacuccaucgacaaccgcguccucgugagccggaaggagaacgcccgcaagacggacuccuaccuguacacccccgaccugaucaagaacaugcgcccgcucugggggaagcugcuggccgccggccucaugagccagaagaaguacgacgcccugacccggguggacgacuucaaggaccgcgagaagcagcgguucguccagcgcucccugguggagacccggcagaucaugaagaacgugagcacgauccuccgcaccuacuacggcgaggacaccaacgucgugacccugaaguccagcaucacccacgacaugcggaaguaccugggguuccccuacaagaaccgcgacaucaacgacuaccaccacgcgcaggacgcccucugcaucagcgccgccggccaguucaugcugaaccggcacuucguguccgggggcgaggucacggacggggcgagcaacgccuacaacauguaccuggccgaguaccuccaggaguuccgcgacgccaaggcccggggcgagcgcaagcgguccaccgcguucggcuucgugguggggagcauguccagcaaggacgacgagaagcgcaccgaccaccggaccggcgagaucgucugguccgagacgaacgccgaguaccugcgcaaggugaugaacuacaagaagaugcugaucacccagaaggugggggacgucaagacccgggcccucuacgacgagacccgcuacggccacaaggagagcuccgccaagagcaucaaguucgacaaccugcggcgcgacacgucccuguacgggggcuucagcggcgccuccaccgcguacaugaugcucguggaguacaagaagaagaacaagcuggugagcaucaccgcccaggaggccucccugcucgccgucgccgaccagaagaacgacaccgugagcgugauggacgggauccuggcgucccacggccugagcggggccaagauccuccugcccaagaucgucacgggccagcugcucgacuacuccgacgcccuggugacccugcagagcgccagcgagcucaacaccgcgcgccagauguggcugccgcggaacgacuacaacgacaucgacaucauccugaaguccaaggacaucgaggacgccgcccacaagcucggcuacgacagcgacaccgugcacguccugcgccggauccagaagcuguucgaggccguguuccgcguggccgagucccaguucccccuccaccagcugagcaaggaccagcaggaggagauccugcgggacccccagaacuacggguucggcuccgcggucaagcuccucgggggccugcucaaggcccugcacgccaacgccgagaacacgaaccuggccgggcucgugaaggugcugcacggcgacaaggaguacagcgacgacggcaaggcgaaggaguucaagaaguucggguucagcccccgcuggcggcgcaucuccaacccgaccggcuucacccuguccgacagcgacaccuucaucuaccagucccccagcgggaucuucgagcagcgggucacggugaaggagcucaaggagaaggccgacaagcagaaguga

SEQ ID NO: 2233 - RNA, 4422 nt, Artificial Sequence
  Cas9 variant
augaagaacauccugggccucgaccuggggaccaacagcaucggcugggcccugaucgagaaggacaccgaccagaagaacgggaacauccucggcacggggucccgcaucauccccaugagccaggacaucaaggacgaguucggcaagggcaacuccaucagccagaccgccgaccggaccaaguuccgcuccgugcggcgccugcgggagcgccaccuccuccggcgcgagcggcugcaccgcguccugaacgugcucggguuccugccgaagcacuacgcggaccagaucgacuucaagaagcggcugggcaagcucgugaacgagaccgagcccaagcuggucuacgacaacaagaacuucaucuucaagaaguccuucgaggccaugcugagcgacuucaaccagcaccagccccuccugcuggccgacgggaagaaggugcccuucgacuggacgaucuacuaccuccgcaagaaggcccugaccgagaagaucgagaaggaggagcuggccuggcucauccugaacuucaaccagaagcggggcuacuaccagcugcgcggggaggaggaggaggagaacccgaacaagaugguggcguuccacagccucaagaucgucgaggugaucgccgacgagucccagaagggcaaggccgagaccugguacagccugauccuggagaacggcuggaucuaccggcgcuccagcaagacgccccucuacgacuggaaggggaagcagcgggacuucaucgugaccaccgaccugaacgacgacggcuccaucaagaccgacaaggaggggcuggagaagcgcagcuuccgggcccccgucgaggacgacuggacccucgugaagaagaagacggagcaggagaucaaccgcucccacaagaccgugggcaccuacaucuacgagaaccugcugcaggaccccaagcagaagaucaagggcaagcucguccggaccaucgagcgcgaguucuacaaggacgagcugaagaugauccugaagaaccagcagaaguuccacccggagcucaacgacgagcaccuguacaucaacugcgugcgcgagcuguaccggaacaaccaggcgcaccagacgauccucagcaagaaggacuucgugcaccuguucaucgacgacaucaucuucuaccagcgcccccugcggucccagaaguccagcaucagcaacugcacccucgaguuccgcaaguacaagaacgagaacgggaccgaccagaccgacuaccugaaggccauccccaagagccacccccuguuccaggaguuccggcucuggcaguggaucuacaaccugggcaucuaccagaaggaggacgacacgaacgucaccgacgagcugaucaagaacaucgacggguaccaggaccucuucgacuuccugaacaacaagaaggagauccgccaggacauccugaucaaguuccugguggagcagaccggccucaaggggaagccgcuguccagcguggucgccaaguaccgguggaacuucguggaggacaagaucuaccccugcaacgagaccggcacgcagauccgcacccggcuggccaagguggagaacacccccgaggacuuccucaccgccgagacggagaucaagcuguggcacaucaucuacuccgucaacgacaaggcggacuacgagaaggcccugaagaccuucgccgagaagcacaaccucgacacccacagcuucguggagaacuucaagaaguucccgcccuucaaguccgaguacggcagcuucuccgagaaggccaucaagaagcugcugccccucauccgccuggggaaguacuggagcugggagaacaucgacaagaagacccaggagcggaucgagaagauccugacgggcgaguucgacgaggccaucaagucccgcgugcgggacaaggcgauccaccucaccgaggaggaccacuuccaggggcugcagcuguggcucgccagcuacgucguguacggccgccacuccgaggccgacaaccuggacaaguggcacaccgucgccgaccuggaggacuaccucgccgaguuccggcagcacagccugcgcaaccccaucguggagcaggucaucaccgagacgcugcggguggugaaggacaucuggcuccaguacgggcagggcgcgaaggacuucuucuccgagauccacaucgagcuggcccgcgagaugaagaacaccggcgacgagcggaagcgccugaccagccucgugaccgacaacgagaacaccaaccugcgcaucaagguccugcucuccgagcugcugaacgacgggaacguggagaacgugcggcccuacagcccgaugcagcaggaggcccucaagaucuucgaggacggcguccugaacuccgacaucgagaucgaggacgacauccugaagaucagcaagauggcccagcccacgaacaccgagcucaagcgcuacaagcuguggcuggagcagaaguaccggucccccuacaccgggcagaucaucccccucaaccgccuguucaccgccgacuacgagaucgagcacaucaucccgcagagccgguucuucgacgacagcuucuccaacaagaucaucugcgagagcgcggugaaccagcugaaggacaagcagcucggccuggaguucaucaagaaccacuccgggacgaucgugaagcugggcaugggcaagaccgccaagauccucgacgucgagagcuacaacgaguucgugaaggggaacuacaccaagaacaucuccaagcgcaacaagcugaugcuggaggagauccccgacaagaugaucgagcggcagcucaacgacacccgcuacaucagcaaguucaucaucuccgcccugagcaacaucgugcgguccgagagcaacgacgacggcuucaacuccaagaacguccugcccgggaacggcaagaucacgagccgccucaagcaggacuggggcaugaacgacaucuggaacgagcugauccugccccgguucgagcgcaugaacaagaucaccgacuccgccguguucaccgcguggaacgagaacaaccagaaguuccucccgaucgugccccuggaguucagcaagggguuccagaagaagcggaucgaccaccgccaccacgcccuggacgcccucgucaucgccgccuccacccgggagcacaucaaccugcugaacaacgagcacgccaagagcgacaagcgcuucgaccucaaccggaagcugcgcaaguucgagaagguggcguacaacgaccccaagacgggcaagcggaucgagaaggaggugccgaccaucuuccugaagcccugggagaccuucaccgucgacgccaagaacucccucgagagcaucaucgugagcuucaagcagaaccugcgcgugaucaaccgggccacgaacuacuccgagagcuacaacgacgagaacggggcccugcgccucggcaaggacgggaacccccugaaggagaagaucaagcaguccaagggcgacagcugggcgauccgcaagcccaugcacaaggacuucgucuacggcaaggugcaccuccagaacgugaagcugccgaaggacaaguucaucaccgccauccggaagucccuggacgucaccuucgaccugaagcgcaucgagaccaucacggacaccgggauccagaagauccucaagaacuaccugcacagcaaggagaacaagguggagcuggccuucucccccgagggcaucgaggacaugaaccagcacaucgagcgguacaacgacgggaagaagcaccagcccauccacaaggugcgcgucuucgagaucggcagccgguucucccucggggagagcggcaacaagaagaccaaguucguggaggccgccaagggcaccaaccuguucuucgcgguguaccaggacgacaacaaggggaagcgcaacuacgagacgaucccccugaacaucgucaucgagcggcagaagcucggccugcacuccgugccgaccgaggacgccaagggcgggaagcugcuguuccaccugagccccaacgacaugguguacguccccaccuccgaggagcuggaggacaaccucgccagcgugaacaucaagcgccugaacaccgcccagcggaagcgcaucuacaagguggagaaggcguccggggucgagugcuacuucauccggcaggacaucgccuaccugaucaagaacuacgacgccaagacgaagaucggcgagcucgagagccagaacaagcugcagaccaccaugaccgacgaccgccugaagaucacggacgugugcgugaagcucaacaucgaccggcugggcuccaucgccgagaccuuccuggggaaccaguacggcgccagcaagaagaccuga

SEQ ID NO: 2234 - RNA, 4422 nt, Artificial Sequence
  Cas9 variant
auggccaagauccugggccucgaccuggggaccaacagcaucggcugggccguggucgagcgcgagaacaucgacuucucccugaucgacaagggggugcggaucuucagcgagggcgugaaguccgagaaggggaucgagagcucccgcgcggccgagcggaccggcuaccgcagcgcccggaagaucaaguaccgccggaagcuccgcaaguacgagacgcugaagguccugucccucaaccggaugugcccccugagcaucgaggagguggaggaguggaagaaguccggcuucaaggacuacccgcugaaccccgaguuccucaaguggcugagcaccgacgaggaguccaacgugaaccccuacuucuuccgcgaccgggccagcaagcacaaggucucccuguucgagcucgggcgcgccuucuaccacaucgcgcagcggcgcggcuuccugagcaaccggcuggaccaguccgccgaggggauccucgaggagcacugccccaagaucgaggccaucguggaggaccugaucagcaucgacgagaucuccaccaacaucaccgacuacuucuucgagacgggcauccuggacagcaacgagaagaacggguacgccaaggaccucgacgagggcgacaagaagcuggugucccuguacaagagccuccuggcgauccugaagaagaacgagagcgacuucgagaacugcaaguccgagaucaucgagcgccucaacaagaaggacguccugggcaaggugaaggggaagaucaaggacaucagccaggccaugcuggacggcaacuacaagacccucgggcaguacuucuacucccuguacagcaaggagaagauccggaaccaguacaccucccgcgaggagcacuaccugagcgaguucaucaccaucugcaaggugcagggcaucgaccagaucaacgaggaggagaagaucaacgagaagaaguucgacggccucgccaaggaccuguacaaggccaucuucuuccagcggccgcugaagucccagaaggggcucaucggcaagugcagcuucgagaaguccaagagccgcugcgccaucucccaccccgacuucgaggaguaccggauguggacguaccugaacaccaucaagaucgggacccagagcgacaagaagcugcgcuuccucacccaggacgagaagcugaagcugguccccaaguucuaccgcaagaacgacuucaacuucgacgugcucgcgaaggagcugaucgagaagggcuccagcuucggguucuacaaguccagcaagaagaacgacuucuucuacugguucaacuacaagcccacggacaccguggccgccugccaggucgccgccucccugaagaacgcgaucggcgaggacuggaagaccaagagcuucaaguaccagaccaucaacuccaacaaggagcaggucagccggacgguggacuacaaggaccucuggcaccuccugaccguggccaccagcgacguguaccuguacgaguucgccaucgacaagcugggccuggacgagaagaacgccaaggccuucuccaagaccaagcucaagaaggacuucgcgagccugucccugagcgccaucaacaagauccugccguaccucaaggaggggcugcuguacucccacgccguguucgucgccaacaucgagaacaucguggacgagaacaucuggaaggacgagaagcagcgcgacuacaucaagacgcagaucagcgagaucaucgagaacuacacccucgagaagucccgguucgagaucaucaacggccugcugaaggaguacaagagcgagaacgaggacgggaagcgcguguacuacuccaaggaggccgagcagagcuucgagaacgaccucaagaagaagcugguccuguucuacaaguccaacgagaucgagaacaaggagcagcaggagaccaucuucaacgagcuccugcccaucuucauccagcagcugaaggacuacgaguucaucaagauccagcggcucgaccagaaggugcugaucuuccugaagggcaagaacgagaccgggcagaucuucugcacggaggagaagggcaccgcggaggagaaggagaagaagaucaagaaccgccucaagaagcuguaccaccccagcgacaucgagaaguucaagaagaagaucaucaaggacgaguucggcaacgagaagaucguccuggggagcccccucaccccguccaucaagaaccccauggccaugcgggcccugcaccagcugcgcaaggugcucaacgcccugauccuggagggccagaucgacgagaagaccaucauccacaucgagauggcgcgggagcucaacgacgccaacaagcgcaaggggauccaggacuaccagaacgacaacaagaaguuccgggaggacgccaucaaggagaucaagaagcuguacuucgaggacugcaagaaggagguggagcccacggaggacgacauccugcgcuaccagcucuggauggagcagaaccgguccgagaucuacgaggagggcaagaacaucagcaucugcgacaucaucggguccaaccccgccuacgacaucgagcacaccaucccgcgcagccggagccaggacaacucccagaugaacaagacccugugcagccagcgcuucaaccgggaggucaagaagcaguccaugcccaucgagcugaacaaccaccucgagauccugccccgcaucgcccacuggaaggaggaggcggacaaccugacccgggagaucgagaucaucagccgcuccaucaaggccgccgccacgaaggagaucaaggacaagaagauccgccggcgccacuaccucacccugaagcgggacuaccugcagggcaaguacgaccgcuucaucugggaggagcccaaggugggcuucaagaacagccagaucccggacaccgggaucaucaccaaguacgcccaggcguaccucaaguccuacuucaagaagguggagagcgucaagggcgggaugguggccgaguuccggaagaucuggggcauccaggaguccuucaucgacgagaacggcaugaagcacuacaaggugaaggaccgcagcaagcacacgcaccacaccaucgacgccaucaccaucgccugcaugaccaaggagaaguacgacguccuggcccacgcguggacccuggaggaccagcagaacaagaaggaggcccgguccaucaucgaggccagcaagcccuggaagacguucaaggaggaccuccugaagaucgaggaggagauccuggugucccacuacacccccgacaacgugaagaagcaggccaagaagaucguccgcgugcgggggaagaagcaguucguggcggaggucgagcgcgacgugaacggcaaggccgugcccaagaaggccgccagcgggaagaccaucuacaagcucgacggcgaggggaagaagcugccgcggcugcagcagggcgacaccauccgcggcucccuccaccaggacagcaucuacggggccaucaagaacccccugaacacggacgagaucaaguacgucauccggaaggaccuggaguccaucaagggcagcgacguggaguccaucguggacgaggucgugaaggagaagaucaaggaggcgaucgccaacaaggugcuccugcugagcagcaacgcccagcagaagaacaagcucgucgggaccguguggaugaacgaggagaagcgcaucgccaucaacaaggugcggaucuacgccaacuccgucaagaacccccugcacaucaaggagcacagccugcucuccaagagcaagcacgugcacaagcagaagguguacggccagaacgacgagaacuacgcgauggccaucuacgagcuggacgggaagcgcgacuucgagcugaucaacaucuucaaccucgccaagcugaucaagcagggccagggcuucuacccccugcacaagaagaaggagaucaaggggaagaucgucuucgugccgaucgagaagcggaacaagcgcgacgugguccucaagcggggccagcaggucguguucuacgacaaggagguggagaaccccaaggacaucuccgagaucguggacuucaaggggcgcaucuacaucaucgagggccugagcauccagcggaucgugcgccccuccgggaaggucgacgaguacggcgugaucaugcugcgcuacuucaaggaggcccggaaggccgacgacaucaagcaggacaacuucaagccggacggcguguucaagcucggggagaacaagcccacccgcaagaugaaccacaaccaguucaccgcguucgucgagggcaucgacuucaaggugcugcccagcgggaaguucgagaagaucuga

SEQ ID NO: 2235 - RNA, 4425 nt, Artificial Sequence
  Cas9 variant
augaagaagauccugggccucgaccuggggaccaacagcaucggcugggcccugaucgaguccgacuucgagaagaagcaggggaagaucaacggccucgggagccgcaucauccccaugucccaggacauccugggcaaguucgacagcggcguguccaucagccagaccgccgagcggacguccuaccgcgggguccggcgccugaaccagcggaaccuccugcgccgggagcgccugcaccgggugcucaacauccuggacuuccugccgaagcacuacagcaacgcgaucgacuucgagaagaagcucggccaguucaaggagaacguggaggagaagcugaacuacgccaagaaccagaucgggcgccacgaguucaucuucauggacuccuucaaggagauggucaaggaguucaagcagacccagccccagcuguucuacaagcgggagaacggcaucgagaccaagauccccuacgacuggacccucuacuaccugcgcaagaaggcccugagccagaagaucaagaaggaggagcucgccuggaucauccugaacuucaaccagaagcggggguacuaccagcugcgcggcgaggacgugcucgacgaguccaagaucgaggacuucuacagccugaagguggucgaggugcaggagacggaggacaagaacgcccggggcaccugguacaacgugauccuggagaacgacugggucuacaagcgccaguccaaggagagccucgacaacuggaucgggaagaacaaggaguucaucgugaccaccaacaaggagaaggacggcucccugaagcuggacaaggcggggaacgugaagcggaacuuccgcgccgucgacagcgagaaggacuggaucgccaucaagaagaagacggagcaggacguggagaucuccaagcacaccgugggccaguacaucuacgagacccuccugcagaacgccaagcagaagaucaagggcaagcuggucaagaccaucgagcggaaguucuacaaggaggaguucaucaagaucaucaaggagcagcucaagcaccaccccgagcugcagagcaagacgcuguacgagaccugcauccaggagcucuacccgcgcaacgaggcgcaccagaacaacaucaaguccaagggguucgaguaccuguucaccgacgacaucaucuucuaccagcggccccucaagagcaagaaguccaccaucagcggcugccaguacgagacgcgccucuucaagaagaccgugcugaacaaggugaccaacaaggagaacgagaucuggcagaaggagccccugaaggccaucagcaagucccacccccucuuccaggaguuccgccuguggcaguuccugaagaaccucaagaucuaccagaaggaggacgucaaggggaaccugaucgaccacgacaucaccagcgaccugcucaagacggaggccgacuggguggagcuguucgacuuccugaacaucaagaaggagaucgagcagaagcagaucauccaguucuucaucaacaacaagcagaucgagaagggcaagaagaacaacuaccgguggaacuacguggaggacaagaaguacccgugcaacgagaccaagucccagcucaucagccgccugaagaaggucaagaaccuggaccugaaccucuucuucaccuccgagaccgagcugaagcuguggcacaucaucuacagcgugaaggacaagauccaguacgagaaggccaucaagaacuucgccaucaagaacaacaucgacaucgacuccuucguggagaacuucaagcgguucccgcccuucaagaacgaguacgcggccuacagcgagaaggccaucaagcgccuccugccccugaugcggaugggggaguacuggaacgaguccgagaucaagcaggaggucaaggaccgcgccuacagcaucaucgagcggcucaagggcaucgacuucaacaaggacaagaucgacgagaagaucacggacgacgacaucaagaagcagcugcugaaguccuucaucgacuucaaggacaagaacccccucaagggccugaacaccuaccaggccugcuaccugguguacaaccgccacagcgaggucaacuccaucgcguacuggaagucccccgacgacaucaacaaguaccucgagggguucaagcagcacagccugcggaaccccaucguggagcaggucgugaccgagacccugcgcacggugcgggacaucuggcaguacuacggcaaggggaaggccagcuucuucaacgagauccacguggagcucggccgcgagaugaagaaccccgccuacaagcggaaggccuccaccaaccgcgucaccgagaacgagaacaccaaccaccggaucaaggagauccugaaggagcugcagaacgagggggugcaggaggucaagagcuacagccgcaaccagcaggagauccucaagaucuacgaggagggcaucuaccaguccaucgacgugguggacgacgccaucgagaagauccggaagaacagcuccccgacgaaggcggagaucaucaaguacaagcuguggcuggagcagggcuacaccagccccuacaccgggaagaccauccccauguccaagcuguucacgaccgacuaccagaucgagcacaucaucccccagagccuguacuucgacaacucccugagcaacaagaucaucugcgaguccgaggugaaccagcucaaggacaaccagaccgccuacgaguucaucaagaagcacggcaccgagaaggucagccuggggaagaacaagaccguggagaucuucacgcuggagcaguacgagaagcacugcaaccaguacuucaagaagaacaagaacaagcucaagaagcugcuguccgaggagaucccggagggcuucaucaaccgccagcucaacgacagccgguacaucuccaaguucaucaaggggcugcugggcaaccucgugcgcgaggaggacgagcaggaggucaccaccaagcacaucgugcccgugaccggcgccaucacgagcaagcugaagcaggacugggggcugaacgacaaguggaacgagcucgucgccucccgcuuccagcggcugaacaccaugaccaacagcaacaacuucggcuacugggacaccaagaucaacgccuuccgcguccaggugcccgacgagaucuccaagggguucagcaagaagcggaucgaccaccgccaccacgcgcuggacgcccucgugaucgccugcugcacgcggaaccacaucaacuaccugaacgcccugaacgcggagaagaagaacuacggccuccgcgaccugcugcucaucaagaacgacaagaaccacuacaccaaguucuucaagcaccccugggacggcuucccgguggaggccaagagcgugcuggagaagaccaucaucuccuucaagcagaacacccgggucaucaacaagacgaacaacaagaccuggcagugggccgagaaggaggggcagcugaagaaggugcucgugaagcagaccaagggcgacaacugggccauccgcaagcccaugcacaaggagaccgucagcgggaagcugaacauccccacgcccaagggcaagaucgccaccgcgucccgggugagccuguccgagaucaagacccgcaagcagcucgacaagaucaccgacaucagcauccagaagauccuggagcggcaccugaacaacuaccucgacgacaaggggaaggagaaguucgaccuggccuucaacgccgacggcguggaggagcugaacaagaacaucaagguccucaacaagggcaagaaccaccagccgaucuacaaggugcgccuguacgagaucgggucccgguucaaggugggcaacagcgggaacaagaaggacaaguacgucgaggccgccaagggcacgaaccuguucuucgcgaucuaccucaacgagaaggacaagaagcgcguguacgagaccaucccccugaacgaggugaucgagcaccagaagcaggucuccaaccugcccaagaacgagcggaccccggugcccgugaaccacaccaaggggaaguuccucuucagccugucccccaacgaccuggucuacgugcccacggacgaggagaucgacaacccgagccucgugaacuucaacaaccugaacaagaagcaggucgagaagaucuacaagaccguguccugcagcaccuaccagugcuucuucgugcacaacaccaucuccaagcccauccagaacaaggucgaguucagcgcccugaacaagauggagaaguccaucgacggcaucaugaucaaggaccgcugcuggaagcucaagauggaccggcugggcaacaucaucagcgugauccgcuga

SEQ ID NO: 2236 - RNA, 4443 nt, Artificial Sequence
  Cas9 variant
augaagaccauccugggccucgaccuggggaccaacagcaucggcugggccaaggugugcgucgacaacgacgggaacuaccugcgcgacaucaagcucggcucccggaucauccccaugagccaggacacgcuggggaacuucgacaagggcgugaccgacuccccgaccgccgcgcgcaccggcuuccgcggggugcggcggauccgcgagcgggcccugcagcgccgggagcgccuccaccggguccugcacgugaugaaguuccugccgccccacuacgagaacgccaucggcuggaaccgcgaggaggccacgaccuacgggaaguuccucaaccacggcgagcccaagcuggccugggagaagcaggaggacgggagcaugcgguuccuguucauggacuccuuccacgagaugauggcggacuucgccgagagccagcccggccucguggccggcgggaagaagaucccccuggacuggacccuguacuaccuccgcaagaaggcccugacccaggcgauccggaaggaggagcuggccuggauccuccugaacuucaaccagaagcgcggcuacuaccagcugcgcggggaggaggacgaggagaaccccgccaagcgggaggaguaccacgagcucaaggucguguccguggaggccgccgaggagggcaagggcgggaacacgugguacaacgucacccuggagaacggcuggaucuaccggcgccagagcaagguggagcugcacgacuggguggggaagacccggcaguucaucgucaccacggaguacgagaaggacggcgugaccaucaagaaggacaagaacggggaggugaagcgcuccuuccgcgcgcccagcgaggacgacuggggccuccggaagaagcgcaccgagucccugcuggaggacagcggcaagaccgucggggccuucaucuacgaccacauccucuccgagccgacggacaagauccggggcaacuucauccgcaccaucgagcggaaguacuacaagaaggagcuggaggccauccugcucgagcagaccaagcaccacaaggagcugaaggaccagaacacccugaucgccugcaucaaggagcucuaccagagcaacaagccccaccaggacucccugaugaagaaggacaugacguaccugcucaucaccgaccugaucuucuaccagcgcccccucaagagcaagaagucccucaucgccgacugccccuacgaguacuacgaguacaccaucaaggagaccggggagaucaagcggcagggcaucaagugcaucgccaagagcaacccguacuaccaggaguuccgccuguggcaguucaucaucaaccugcggcuguucgaccgcacggacgacaaggaggugaccuccgaguaccugagcagcauggaggacuacaccaagcuguucaccuaccucaacgaccggaaggacaucaaccaggagacgcugcugaaggacuucuucaagcagaagaaggugaagauggggauggagaaggaguuccccauccgcuggaacuacaucgaggacaaggagaagaaguaccccugcaacgagacccggcacgagcuccuggcggcccuggacaaggccggcaucgaccacuccuggcuggacgacaaggagcgcuucuaccggcucuggcaccuccuguacagcgucgaguccaaggaggaggccgagggcgcgcuccgcaagcugaaggacaacgacgacuucgugaacgccuuccugaaggugaagcccuucaagaaggacuacggggccuacagcgagaaggccgucaagaagcuccuggccaucaugcggaugggcgggcuguggaacgagaccgacaucugcgagcagacccgcaaccggauccaguccaucaucaagggcgagaucgacgagaagaucaaggagcgcauggggcgcacguucugccagcucagcgacuuccagggccugccggaguggcuggcgugcuacgugguguacggccggcacuccgaggccaccgacauccagcgcuggaccaagcccgagaaccucauggccuacaucaacggguucaagcagcacagccugcggaaccccaucgucgagcagugcauccuggagacccuccgcacggugcacgacaucuggaaggaggccggccacaucgacgagauccacgucgagcuggggcgguccaugaaguccaccgcggaccagcgcgcccggaugagcaagagcauccugcagaacgagaacaccaaccuccgcaucaagucccugcugauggagcucaagaacgccaaggagaucgagaacgugcggcccuacagcccgaugcagcaggagauccugcgcaucuacgaggagggcgcccugcaggagcucaccaaggaggacgcccaguaccccgagaucuccaagaucagccagauggcgcagcccuccgccaaggagcugcugaaguaccggcucuggcuggagcagaaguacugcagccccuacaccggcaagccgaucucccugagcaagcuguucacgagcgccuaccagaucgagcacaucaucccccagucccgcuacuucgacgacagcuucaccaacaaggugaucugcgagaccgaggucaaccagcugaaguccaacaugcugggguacgaguucaucaagaagcacagcggcgagaucgugcacugcaccacgaucggggacgugaagauccucgacgccaaggaguacuacaacuucgucaccgagcacuacgccaacaaccggcgcaagaaggagaagcugcugcucgaggacaucccccaggaguuccugaaccggcagaugaacgacucccgcuacaucagcaagaaggugauggcgauccuguccaacaucgugcgggaggaggacgagcaggagaccaacagcaaguucgucguguccugcagcggcgggaucaccgaccgccucaagcaggacuggggccugaacgacguguggaacuccaucgucuacccccgguucgagcgccugaacaagcucacgcagaccgaggccuucggccggugggagaacaaggaggggaagcaggucuuccagaccagccugccgcuggagcuccagcgcggcuucuccaagaagcgcaucgaccaccggcaccacgccauggacgcccuggugaucgccugcgcgagccgcaacaucaucaacuaccugaacaacgaguccgccaagagccaggagcagcgggaggaccuccgcaagaagcugugcgacaagaaccggaucauccgcaagcccugggagaccuucacgcaggacgcccggaccgcccuggaggacguggugguguccuucaagaacuacguccgcgugaucaacaaggcgaccaacuacuacgagaaguacgacgagagcgggaagaagggcauggccgagcagaaggggcaggacaugugggccauccggaagcccaugcacaaggagaccguguucggccaggucaaccuccgccggaaggugacggugaagcugaaggacgcccuggagaacaucccggccaucugcgacaaggcgcuccgcgacuacgucaacgaccugaucgccaagaaguucaacaccaagcagaugcuggcccacuucaagagcaucaacuaccggcucaacaugaaguccgugaacaaggugggcaucugggucuucagcgacgagaaggagcccaugguggccacccgcaaggccaucgacaucuccuucgacgcgaagcggaucgacaccaucacggacaccgggauccagcagauccugugcaaguaccucaagagcaagggcaacgaccccaacguggccuucacccccgaggggaucgccgagaugaacaagcacaucaucgacuacaacaacggcaagcagcaccagccgauccugaagguccgcguguccgagcccaagggggccaaguaccaggugggcgagaccggcaacaagacgaagaaguucgucgaggcccagaaggggaccaaccuguacuucgcgaucuacgaggacaaggacggcaaccggagcuacaacaccaucccccugaacgagguggccgagcgccucaagcaggggcugucccccgugccggagaagaacgagaagggcaucagccugaaguucuaccucucccccaacgaccuggucuacgugcccaccgaggaggagaagcugagcaacgagugcaagcucuccaaggagcggaucuacaagauggugagcuccacgagcaacgagugccacuucauccccuacaccaccgccaagccgaucuacgacaaguucgaguacgaggccaagaacaagauggggcgcgcgcugaccggcgagaugaucaaggccgucugcuggaagcuggagguggaccgccucggcaacauccugaagaucaucaaguga

SEQ ID NO: 2237 - RNA, 4452 nt, Artificial Sequence
  Cas9 variant
augaagaccauccugggccucgaccuggggaccaacagcaucggcugggccaagaucuccaucgacgacaacgggaacuaccugcgcgacauccagaugggcagccggaucauccccaugucccaggacgugcucgggaacuucgacagcggcgucacggagucccagaccgccgugcgcaccggcuuccgggggcugcgccggauccgcgagcggagccugcuccgccgggagcgccugcaccgggugcugcacgucaugggcuuccucccgccccacuacgacuccgcgaucggguggaacaaggaggagcccaccacguacggcaaguuccugaaccacggggagcccaagcuggccugggagcgccagggcgacggcagcaugcgguuccucuucauggacuccuuccacaagaugauggaggacuucgccccgcaccagcccgcccugguggccgacgggcgcaagaucccccuggacuggacccucuacuaccugcggaagaaggcgcugacccagcccaucaagaaggaggagcucgccuggauccugcugaacuucaaccagaagcgcggcuacuaccagcuccgcggggaggaggaggaggagaacccgaccaagcgggaggaguaccacgagcugaagguggucagcguggaggccgccgaggagggcaagggcgggaacacgugguacaacgugaagcuggagaacggcuggaucuaccggcgcuccagcaagaucccccucgacgacugggucgggaagacccggcccuucaucgugaccaccgaguacgaggcggacggcaucacgcugaagaagaacaaggagggggaggugaagcgcuccuuccgcgcccccggcgaggacgacuggggccugcggaagaagcgcaccgagagccagcucgaggccuccgggaagaccgucggcgccuucaucuacgaccaccuccuggccgagccggcggacaagauccgggggaacuucauccgcaccaucgagcggaaguacuacaagcaggagcuggccgacauccugcgcgagcagagcaaguaccacgaggagcugcaguccaagaagauccucgccgacugcgccgaggagcuguaccggagcaaccagccccaccgcgacucccugcucaagaaggacaugguguaccugcugcucacggacaucaucuucuaccagcggccccucaagagcaagaagucccugaucgccgacugccccuacgaguacuacgaguacguggacaaggagaccggcgagaucaagcgccaggggaucaagugcgucgccaagagcaacccguacuaccaggaguuccggcuguggcaguucgugcugaaccugcgccucuacgaccggaccgaggacaaggaggugaccgcggaguaccugcccagcaaggaggacuacgcccgccuguucgucuaccucaacgaccggaaggagaucaaccaggagacgcugcugaaggacuucuucaagcugaagaaggugaagcagcgcuccgagaaggaguuccccgugcgguggaacuacaucgaggacaaggagaagaaguaccccugcaacgagacccgccacgagcuccugauggcccuggaccgggccggcaucgagcgcagcuggcucgacgacaccgcgcgccagugccggcuguggcaccuccuguacuccaucgaggucaaggacgaggccgagcgcgcccugcggaagcugaaggacgacgacgaguucgugagcgccuuccucaaggugaagccguucaagaaggacuacggcgccuacuccgagaaggcggucaagaagcugcuggccgugaugcgcauggggagccacuggugcgaggacgacaucugcaaggagaccaaggagcggaucgagcacauccuccagggcgacgucgaggagaagaucaaggagcgcaugaaccacacggccuacucccugggggagcugagcgacuuccaggcccuccccgaguggcuggcgugcuacgugguguacggccggcacuccgaggccaccgacaucaagcacuggaagacccccgagagccugauggccuacaucaacggguucaagcagcacucccuccgcaaccccaucgucgagcagugcauccuggagacccugcggacggugcacgacaucuggaaggaggccggccacaucgacgagauccacguggagcucggccgcagcaugaaguccaccagcgaccagcgggcccgcaugaccgagaacauccugcggaacgagaacaccaaccugcgcaucaagucccuccugauggagcugaagaacgacgcggacaucaaggacguccggccguacagccccaugcagcaggagauccuccgcaucuacgaggagggggcccugcaggagcugacgaaggaggacaacgacuacgaggagaucuucaagaucuccaagaugccccagcccagcgccaaggagcuccugaaguacaagcuguggcucgagcagaaguaccggagcccguacaccggcaagcccaucucccugagcaagcuguucaccuccgccuaccagaucgagcacaucaucccccagagccgcuacuucgacgacuccuucaacaacaaggugaucugcgagagcgaggugaacgcccucaaggggaacaugcugggcuacgaguucaucaagaaccacggcggggagaucguccacugcacccugcucggcgacgugaaggugcagaacgaguccgaguacaaggcguucgucacggagcacuacgccaacaacaaguacaagaaggagaagcugcugauggaggacaucccgcaggacuuccucaaccggcaccugaacgacagccgcuacaucuccaagguggugaagacccugcucagcaacaucguccggaccgaggacgagauggagaccaccuccaaguucguggugagcugcaccgggggcaucacggaccgccugaagaaggacugggggcugaacgacgucuggaacuccaucguguacagccgcuucgagcggcucaacgagcugaccaaguccgacgccuucggccgcugggagaacaaggagggcaagcggguguuccagaccagcgucccccuggagcuccagcgcggguucaacaagaagcggaucgaccaccgccaccacgccauggacgcccuggugaucgcgugcgccucccggaacaucaucaacuaccugaacaacgagagcgccaacagccccaagaagcgcgaggaccuccggcagcagcugugcgacaagaaccgcaucauccggaagcccugggaguccuucacgcaggacgcccgcgcggcccuggaggacguggucgugagcuucaagaacuacgugcgggucaucaacaaggccaccaacuacuacgagcgcuacgacgccgacggcaagaagaccaucaccaagcagaagucccgggagaugugggccgugcgcaagccgaugcacaaggagacgguguucgggcacgucaaccuccggcgcaaggcgaucgugaagcugaaggacgcccuggagaacauccccagcaucugcaacaaggagcuccgggacuacaucaacggccugguggagcgcaacuucaacaccaagcagcugcacgcccacuuccgcuccaccgacuaccgguggaacaagcagaacgucgacaagguggagguguggcgcuucagcgacgagaaggagccccucgucgccacccggaagccccuggacacguccuucgacgccaagcgcaucgacaccaucaccgacaccgggauccagaagauccugcucaacuaccuggaggcgaagggcggcgacccgcugaucgccuucacgcccgaggggaucgccgagaugaaccagaacaucgcccucuacaacgacggcaagaugcaccagcccauccugaaggugcggaucagcgagcccaagggggccaaguaccagaucggccagaccgggaacaaggcggacaaguucguggaggcccagaagggcaccaaccuguacuucgccaucuacgaggacgaggaccgcaaccggaccuacaacacgaucccgcucaacgaggucgccgagcgccugaagcagggccugccgcccgugcccgagaagaacgagaaggaggugccccucaaguucuaccugucccccaacgaccuggucuacgugcccaccgaggaggagauccucaugaaggagugcaagcugaacaagaaccggaucuacaagauggugagcuccaccgggaaccagugcuucuucauccccuuccgcgucgcggugagcaucgugaacaagauggaguacuccccgcugaacaagauggagaaggccaucagcuccgagaugaucaaggccgucugcuggaagcucgagguggaccggcugggcaacaucauccgcguggucaaguga

SEQ ID NO: 2238 - RNA, 4452 nt, Artificial Sequence
  Cas9 variant
augaagaccauccugggccucgaccuggggaccaacagcaucggcugggccaaggugucccuggacgacaacgggaacuaccuccacgacaucaagcugggcugccgcaucauccccaugagccaggacguccuggacaacuucgggaagggcgugacggugucccagaccagcguccggaccggcuuccgcggggugcggcgcauccgggagcgcucccuccagcggcgcgagcggcugcaccgcgugcugcaccggcucggcuuccugccgcagcacuacgacgccgcgaucgggugggacagcgacugcgccaagaccuacggcaaguuccuggacaacggggagcccaagcucgccugggagcgccaggaggacggcuccaugcgguuccuguucaugaacagcuucuacgagaugaucgccgacuucacgucccaccagcccgcccuggucgcggacggcaagaagaucccccucgacuggacccuguacuaccugcgcaagaaggcccucacccaggccauccggaaggaggagcuggccuggauccugcucagcuucaaccagaagcgcggguacuaccagcugcggggcgaggaggaggacgagaacccgaccaagcgcgaggaguucugcgagcugaaggugguggcggucgaggccgccgagaaggggaagggcgacgacaucugguacaacgugcaccucgagaacggcugcaucuaccggcgcuccagcaagaucucccuggacgacuggguggggaagacgaagcaguucaucaucaccaccgaguacgagaaggacggcgucacccccaagaaggacaaggacgggaaggagaagcggagcuaccgcgcccccaaggaggacgacuggggccugcgcaagaagcggacggagaccgaccucgaggccuccgggaagaccgugggcgcguucaucuacgagcaccuccuggccgagcccuucgacaagauccgcggcaacuucauccacaccaucgagcggaaguacuaccgcgccgagcuggaggccauccugacggagcagcggaaguaccacgaggagcugcgcagcgagcagaugcucgccgugugcgcggaggagcuguaccgguccaaccugccgcaccagcagagccuccugaagaaggacauggucuaccugcuccuguccgaccugaucuucuaccagcgcccccucaagagcaagaagucccugaucgccgacugccccuacgaguacuaccgguacguggacaaggagaccggggagaucaagaagcagggcaucaagugcaucgccaagagcaaccccuacuaccaggaguuccgccuguggcaguucgugcucaaccugcggcuguucgaccgcaugaccgacaaggaggucaccgccgacuaccucccgacgaaggaggacuacgugcggcuguucgacuaccugaacaaccgcaaggagaucaaccaggagacccugcucaaggacuucuuccggcugaagaaggugaagcuggggcgcgagaaggaguucgagauccgguggaacuacaucgaggacaaggagaagaaguaccccugcaacgagacccgcuacgagcuccuggucgcccuggaccgggcgggcaucgaccgcagcuggaucgacgaggacgggcgccaguaccggcucuggcaccuccuguacuccaucgaggugaaggccgaggccgagagcgcccugcgcaagcugaacuccgacgacgccuucgugagcuccuuccugaaggucaagcccuucaagaaggacuacggcgcguacagcgagaaggccgugaagaagcuccuggccgucaugcggaugggcuccauguggagcgaggccaacaucugcgaggagacccagaaccgcauccgguccaucauccgcggggacaucgaggagaagaucaaggagcggaugggccacacggcgcgcagcuucaaccagaucgacgacuuccaggcccugcccgaguggcucgccugcuacgugguguacgggcggcacuccgaggucaccgacauccagcacugggagaccccggagcagcugcagagcuacaucaacggcuucaagcagcacucccugcgcaaccccaucguggagcagugcauccucgagacccugcggacggugcacgacaucuggaaggaggccgggcacaucgacgagauccacgucgagcugggccgcgacaugaagcggaccgccgaccagcgcgcgcggaugaccaagaacauccucaagaacgagaacaccaaccugcgcaucaagagccugcucauggagcugaagaaggacacggacaucaaggaggugcggcccuacucccccaugcagcaggagauccugcgcaucuacgaggagggcgcccuccugcagcugaagcgggacgacgaggccuucgccgacaucagcaagaucucccagauggcccagccgaccgcgaccgagcuccgccgguacaagcuguggcuggaccagaaguaccgcagccccuacaccgggaaguucaucagccucuccaagcuguucacgagcgccuaccagaucgagcacgugaucccccagucccgcuacuucgacgacagcuucuccaacaaggucaucugcgaggccgaggugaaccggcucaagagcaacaugcugggcuacgaguucaucaaggcccacgggggcgagaucgugcacugcaccaugcugggcgacgucaagauccuguccgagagcgaguacaaggccuucgugaacgagcacuacgugaaccaccgcgcgaagaaggagaagcuccugauggaggacaucccccaggaguuccugaaccggcagaugaacgacucccgcuacaucagcaaggucgugaaggcccuccuguccaacaucgugcggaccgaggacgagauggacgucaccagcaaguucguggugccgugcuccgggggcaucaccgaccgccugaagaaggacugggggcucaacgacgucuggaacagcaucguguacccccgguucgagcgccugaaccggaugacgggcaccgaggccuucgggcacugggagaacaaggagggcaagcgcguguuccagaccuccguccccaucgagcugcagcucggcuucagcaagaagcggaucgaccaccgccaccacgccauggacgcgcuggugaucgccugcgccucccggaacaucaucaacuaccugaacaacgagagcgccaacagccagaagaagcgcgaggaccuccggcgccugcugugcgacaagaaccggaucauccgcaagcccugggaguccuucacccaggacgcccggguggcgcuccaggacaucgucgugagcuucaagaacuacgugcgcaucaucaacaaggccacgaacuacuacgagcgcuacgacgagcaggggaagaagaccaccgccgagcagaaguccagcgagaugugggccauccggaagccgaugcacaaggagaccgucuucggccacgugaaccugaagcgcaagacgaccgugaagcugaagaacgccaucgagaacauccccaacaucugcaacaaggagcucaaggcguacaucaacgagcuggucgagaagcacuucaacaccaagcagaugcuggcccacuucaaguccaucaacuaccgguggaaccgccagaacguggagaagguggaggucuggcaguacagcgacgagaaggagcggauggccgccacccgcaagccccucgacacguccuucgacaagaagcggaucgagaccaucaccgacaccgggauccagaagauccugcugaacuaccucgaggagaagggcggggacccgaacaucgccuucacgcccgagggcaucgcggagaugaacaagaacaucagccuguucaacgacggcaagcugcaccagcccauccucaaggugcgcguggccaagaccaugggggccaaguaccaggucggccagaccgggaacaaggccgcgaaguacgugggcgcccaggaggggaccaaccuguacuucgccaucuacgagaacgaggagggcgagcgguccuacaacgccgugccccugaacgaggucgccgagcgccucaagcagggcaugagcccggugcccgagaagaacgagaaggacgugccccugaaguucuaccugucccccaacgaccucgucuacgugccgacggaggaggacaagcugagcaacgagugcaagcuggacaacgagcggaucuacaagaugguguccgcgaccgggaagaagugccacuuccuccccuacagcgucgccaacaucaucuacaacaagguggaguucgaguccaugaacaagaugggcaaggcccugagcggggagaugaucaaggccgugugcuggaagcuggaggucgaccgccucggcaccauccugcgggugaucaaguga

SEQ ID NO: 2239 - RNA, 4452 nt, Artificial Sequence
  Cas9 variant
augaagaccgagcuggaccucaacaaggaccgccuguacaagcacgugcugggccucgaccugggggucaccagcaucggcuucgcccacgugguggaguccgagaaccggaacgagagcgagaucaagcagaucgggguccgcgugauccagcuggacaacuucgacaagguggacaaguccggcaagacgagcgaguccaagaaccccgccgucgacuucgcggccgggaagggccucaccccgaacggcagccggaccaagaagcgcggggcccggcgcaaccuggaccgguaccaggaccgccgggacaaccugcucgaggugcugaccaaguccggcuucaucaacagcgagacgaagcgcaccgaggacgggaagcacaccacccaccagacgugggagauccgggccaaggccguguccgagaaggucgagaaggaggaguucgcgcgcauccugcucgccaucaacaagaagcggggcuacaagagcucccgcaaggccaagaacgaggacgaggggcaggccguggacggcauggcgguggccaagcggcuguacgaggagaaccugacccccggccaguacgccuacgagguccucagcgggggcaagaaguccauccccgacuucuaccgcagcgaccugcaggccgaguucgacaagaucuggaacuuccagaagcaguucuaccccaacauccugaccgacgaguucuacgaggagcucaaggggaagggccagcgggccaccuccgcggccuucuggaagauccaccaguucaacacggccgacaucaaggaccuggaggacgagcugaagaacgagcgcaccaucaagcucagcaagcgggaccagaagaagcugcaggccuacaaguggcgcuccgaggccguggugaagcagcugggcaaggaggaggucgcguacgugcucaccgagaucaacaacaaccugaacaacagcuccggguaccugggcgccaucagcgaccggagcaaggagcucuacuucaacaagcagaccguggggcaguuccuguacaagcagcugaaggagaacccgcacacgcgccucaagaaccaggucuucuaccgccaggacuaccuggacgaguucgagaccaucugggagaugcaggcccaguuccaccccgagcugacccaggagcucaaggaggagauccgggacaucaucaucuucuaccagcgcaagcugaagucccagaagggccugaucagcuucugcgagcucgaguccaaggagguggugaucaacgacaccaagaagaucaucgggcugcgggucgcccccaagagcagcccccuguuccaggaguucaagaucuggcagaaccucaacaacgugcuggugcgcaagaagggcagccggaagcgcauggucaaggcccagaaccagcacucccuguucgaggagccgaaggagaucuucagccucgaccuggcguccaaggagaagcuguucgaggagcucaaccugaagggcaaccugagcgccaagaacugccucgacauccuggggcugaacuccaacgagugggagcugaacuacacgcagcucgagggcaaccggaccaacaagagccuguacgaggccuuccugaagauccucgacaucgagggguacgacgugaaggaccugcugaaggucaaguccagcaaggacgagguggagcucgacgaccugaaggugcccgccuccgagaucaagaacaugguccgcgagaucuucagcaccaacaagaucgacaccgagauccuggacuucgacgccgagaucgacggcaaggcguucgagaagcaguccagcuaccagcucuggcaccuccuguacuccuacgagggggacgacagccagagcggcaacgagaagcuguacgagcugcuggccaagaaguucggcuucaagcgggagcacgcccagauccucgccaacgugucccugguggacgacuacgggaaccugagcuccaaggcgaugcgcaagaucuacccccacauccgggagaacaacuacagcacggccugcgagcucgucggcuaccgccacuccaagcacagccugaccaaggacgagcugaaggaccgggugcucgaggaccgccuggagcugcucaagaagaacucccugcggcagcccguggucgagaagauccugaaccagaugaucaacgccgugaacgcccucaucgagaagaacagcgagcgcgacgagaacgggaacaucaccaaguacuucaaguucgacgagauccggaucgagcuggcccgcgagcugaagaagaacgcggccgagcgggccgagaugaccacgaacaucaacgccgccaagcucgugcacgagaagaucuucaagauccugcagaacgaguucggcaucaagaacccgacccgcaacgacaucauccgcuaccggcuguacgaggagcucaaggggaacggcuacaaggaccuguacuccaacaccuacaucccccgcgagauccuguucagcaaccagaucgacaucgaccacauccucccccagucccggcuguucgacgacagcuucuccaacaaggucgugguguuccgcaaggacaaccugaagaagggcaaccagaccgcgaucgacuacaucgggagcgaggucggcgaggaggggcucaagaacuucaucgagcggguggagucccuguacgagcugggcaagaagaacaaggaggagggcaucagcaaggccaaguaccagaagcuccugaaguccgccagcgagaucggggacggcuucaucgagcgcgaccugcgggagagccaguacaucgccaagaaggccaaggagcuccuguucaaggugacgcgcuccgucgugagcaccuccgggagcaucaccgaccggcugcgcgaggacuggggccucaucaacgugaugaaggagcugaaccugcccaaguacaagucccucgggcugaccgagauccaggagcggcgcaacggccaccaggucgaggugaucaaggacuggacgaagcggaacgaccaccgccaccacgcgauggacgcccuggccguggccuucaccaagcacaaccacauccaguaccucaacuaccugaacgcgcggaagaacgagagccacaagcugcacggcaacaucaucgccaucgagacccucgagaccgaggucaagaucgacgaccuggggaacaagaagcgcguguucaaggagccgauccccaacuuccgccagguggccaaggagcaccuggagaacguccucaucucccacaaggccaagaacaagguggugaccaagaacaagaacaagaucagcggcaaggagaagcugcagaucacgcugacgccccgggggcagcuccacaaggagaccgucuacggcaaguaccgguucuaccaguccaaggacgagaaggugagcgccaaguucgaccuggagaccaucgagaagguggcgaaccccuccuacaaggccgcccugcuccagcgccugaacgagaacgagaacgacccgaagaaggccuucagcgggaagaacgcccuguccaagaaccccaucuacaucagcauggagaacgacaucaagguccccgacaccgugaagcucguguggcuggaggaggacuacuccauccggaaggacgucacccccgagaacuucaaggacgagaaguccaucgagaagauccuggacgagggcgugaagcgcauccucaagaaccgccugaaggaguucggcggggacgcgaaggaggccuucuccgaccuggacaagaacccgaucuggcucaacgaggagaagggcaccagcaucaagcgggugcgcaucuccggggucaagaacgccgagccccugcacuacaagaaggaccacuucggcaacgacauccuggacgggaacggcaacaagauccccgccgacuucgugagcaccggcaacaaccaccacguggccaucuacaaggagcccgaguucgacaagaaggggcagccgguccucgacgagcugggcaaccagaaguacaaccugcaggagaagguggugagcuucuucgaggcggucgagcgggugaaccaggggcuccccaucaucgacaagacguacaaccagcaccugggcuggcaguucuucuucaccaugaagcagaacgagauguucguguuccccaacgagaagacccgcuucaacccgaucgagaucgaccugcucgaccccaacaacaagaagcugaucucccugaaccucuuccggguccagaagaucgccaacaagaacuacauguuccgccaccaccuggagaccaacguggacgacaagaaggagaugaagaacaucgccuucauccacauccagagcugcaaccugcucaaggagaucaucaaggugcggcugaaccaccugggggacaucgucuccgugggcgaguacuga

SEQ ID NO: 2240 - RNA, 4452 nt, Artificial Sequence
  Cas9 variant
augaagaccauccugggccucgaccuggggaccaacagcaucggcugggccaagguguccgucgacgaccacgggaacuaccugcacgacaucaagcucggcagccgcaucauccccaugucccaggacauccuggggaacuucgacaagggcgugacggagagccagaccgccauccggaccggcuuccgcuccgugcggcgcauccgggagcgcagccugcuccggcgcgagcggcugcaccgcguccugcacgugaugggguuccucccgccccacuacgacuccgcgaucggcuggaaccgggaggaggccagcaccuacgggaaguuccugaaccacggcgagcccaagcuggccugggagcgccucgaggacggguccaugcgguuccuguucauggacagcuuccacgagaugauggccaacuucgcccgccaccagcccgcgcugguggccgacggccggaagaucccgcucgacuggacgcuguacuaccugcgcaagaaggcccucucccaggccgucggcaaggaggagcuggcguggauccugcucaacuucaaccagaagcggggguacugccagcugcgcggcgaggaggaggaggagacccccaccaagcgggaggaguacuacgagcugaagguggugagcgucgaggccgccgaggaggggaagggcggcaacaccugguaccgcgugcagcucgagaacggguggaucuaccggcgccccuccaagaucgcccuggacgacugggugggcaagacgaagcaguucaucgucaccaccgaguacgagaaggacgggaccacgcugaagaaggacaaggacggcgaggugaagcgcagcuuccgggcccccggggagaacgacuggggccuccgcaagaagcggaccgagucccagcuggaggcgagcggcaagaccgugggggccuucaucuacgaccaccuccucgccgagccggccgacaagauccgcggcaacuucauccggaccaucgagcgcaaguacuacaagcaggagcuggaggccauccugcgggagcagacgaagcaccacgaggagcuccgcuccaaggagaugcuggcgaagugcgccgaggagcuguaccagagcaaccagccccaccggaagucccuccugaacaaggacaugaccuaccugcuccugaccgaccugaucuucuaccagcgcccccucaagagcaagaagucccugaucgccgagugccccuacgaguacuacaaguacaaggacaaggagaaggggaagaagaagcggcagggcaucaagugcgucgccaagagcaacccguacuaccaggaguuccgccuguggcaguucaucgugaaccuccggcuguucgaccgcaccgacgacaaggaggugacggccgaguaccugcggagccgcgaggacuacgcgcggcuguucgccuaccugaacgaccgcaaggagaucaaccaggagacccugcugaaggacuucuucgggcucaagaaggucaagaucggcgccgagaaggaguucgccauccgguggaacuacaucgaggacaaggagaagaaguaccccugcaacgagacccgccacgagcugcugcucgcccuggaccgcgcgggcauggaccgguccuggcuggacgacagcgagcuccaguaccgccuguggcaccuccuguacuccguggaggcccgggacgaggccgagggggcccugcgcaagcugcgggacgacgacgaguucgugggcgcguuccucaaggucaagcccuucaagaaggacuacggggccuacagcgagaaggccgugaagaagcugcuggccgugaugcgcaugggcuccugguggcacgaggaggacaucugcaagcagacccgggaccgcaucgagcggaucguccagggggacaucgaggagaagauccgcgagcggaugggccacgccgcguacagcuucucccgccucgccgacuuccagggccugcccgaguggcuggccugcuacguggucuacgggcggcacagcgaggccacgcacauccuccgcugggacuccccggacaagcugcugagcuacaucaagggcuuccggcagcacucccuccgcaaccccaucguggagcagugcauccuggagacccugcggaccgugcacgacaucuggaaggaggccgggcacaucgacgagauccacgucgagcucggccgcagcaugaaguccaccgcggagcagcgggcccacaugacgaagaacauccugcgcaacgagaacaccaaccugcggaucaagugccuccugauggagcugaagaacgacgccgacgugaaggacgugcgccccuacagccccaugcagcaggagauccuccgcaucuacgaggagggcgcccugcagcagcugaccaaggacgacgccgaguacgcggagaucuccaagaucagcaagauggcccagccguccgccaaggagcuccugcgguacaagcuguggcucgagcagaaguaccgcagccccuacaccgggaagcccaucagccuguccaagcuguucacgagcgccuaccagaucgagcacgucaucccccagucccgguacuucgacgacagcuucaacaacaaggugaucugcgaguccgaggugaacacccucaagagcaacaugcugggcuacgaguucaucaagaaccacugcggggagaucguccacugcaccaugcugggcgacgugaagguguucuccgagagcgaguacaaggcguucgucaccgagcacuacuccaacaacaaguacaagaaggagaagcuccugcuggaggacaucccgcaggaguuccucaaccgccagaugaacgacagccgguacaucuccaagguggugaaggggcugcugagcaacgucgugcgcacggaggacgagcucgaggccaccuccaaguucguggucagcugcaccggcggcaucaccgaccggcugaagaaggacugggggcugaacgacguguggaacuccaucguguacagccgcuucgagcggcucaacggccugaccaaguccgagcacuucgggcacugggagaacaaggagggcaagcgcgucuuccagacgagcgugcccauggagcugcagcggggguucaacaagaagcgcaucgaccaccggcaccacgccauggacgcccucgugaucgccugcgcgagccgcaacaucaucaacuaccugaacaacgaguucgccaagucccccaagcagcgggaggaccugcgccagcuccugugcgacaagaaccggaucauccgcaagcccugggagaccuucacccaggacgcccgggccgcccuggaggacgucguggugagcuucaagaacuacguccgcgugaucaacaagaccacgaacuacuacgagcgcuacgacgcggacggcaagaagaccauggugccgcagaagggcaacgagaugugggccguccggaagcccaugcacgaggggaccauguacggccgcgugaaccuccggcgcaaggccguggucaagcugaaggaggcccuggagaacaucuccagcaucugcaacaaggagcuccgggacuacaucaacgugcugguggagaagcaguucaacaccaagcagcugcucgcccacuucaaguccauggacuaccgcuggaacaagcagcacaucgacaaggucgagguguggcgguucagcgacgagaaggugcagauggucgcggcccgcaagccccuggacacguccuucgacaaggagugcaucgccagcaucaccgacaccgggauccagaagauccugcucaacuaccuggaguccaagggcggggacccggccaucgcguucaccagcgagggcaucgccgagaugaaccagaacaucgccguguacaacgacggcaagaagcaccagcccgugaucaagguccggaaguccacgaagcuggggaagaaguucgccgugggccagaucgggugcaagagcaagcaguucguggucgccgaggcgggcaccaaccucuacuucgccaucuacgaggacgaggaggggaagcgcuccuacgacaccaucccccugaacgaggugaccgagcggcugaagcagggccucagccccgugccggagaagaacgagaaggaggucccccugaaguucuaccugucccccaacgaccucguguacgugcccacggaggacgagaugcagaugaaggagugcaagcugaacaaggagcgcaucuacaagauggucagcuccaccggcaacgagugccacuuccugccguacagcguggccuccgucaucuacaacaagguggaguucgagagcaugaacaagauggggcgggcccucaccggcgagaugaucaaggccgugugcuggaagcuggacgucgaccgccuggggaacauccuccgggugaucaaguga

SEQ ID NO: 2241 - RNA, 4452 nt, Artificial Sequence
  Cas9 variant
augaagaccauccugggccucgaccuggggaccaacagcaucggcugggccaagaucuccaucgacgacaacgggaacuaccugcgcgacauccagcucggcagccggaucauccccaugucccaggacgugcuggggaacuucgacaacggcgucacggagagccagaccgccgugcgcaccggcuuccgggggcugcgccggauccgcgagcggucccuccugcgccgggagcgccugcaccgggugcuccacgucaugggcuuccugccgccccacuacgacagcgcgaucggguggaacaaggaggagcccaccacguacggcaaguuccugaaccacggggagcccaagcucgccugggagcgccagggcgacggcuccaugcgguuccuguucauggacagcuuccacaagaugauggaggacuucgccccgcaccagcccgcccugguggccgacgggcgcaagaucccccucgacuggacccuguacuaccugcggaagaaggcgcucacccagcccaucaagaaggaggagcuggccuggauccugcucaacuucaaccagaagcgcggcuacuaccagcugcgcggggaggaggaggaggagaacccgaccaagcgggaggaguaccacgagcugaagguggucggcguggaggccgccgaggagggcaagggcgggaacacgugguacaacgugaagcucgagaacggguggaucuaccggcgcuccagcaagaucccccuggacgacugggucggcaagacccggcccuucaucgugaccaccgaguacgaggcggacgggaucacgcugaagaagaacaaggagggcgaggugaagcgcuccuuccgcgcccccggcgaggacgacugggggcucuggaagaagcggaccgagagccagcuggaggccuccggcaagaccgucggggccuucaucuacgaccaccuccuggccgagccggcggacaagauccgcggcaacuucauccggaccaucgagcgcaaguacuacaagcaggagcuggccgacauccugcgggagcagagcaaguaccacgaggagcuccaguccaagaagauccuggccgacugcgccgaggagcuguaccgcagcaaccagccccaccgggacucccuccugaagaaggacaugguguaccugcuccugacggaccugaucuucuaccagcgcccccucaagagcaagaagucccugaucgccgacugccccuacgaguacuacgaguacguggacaaggagaccggggagaucaagcggcagggcaucaagugcaucgccaagagcaacccguacuaccaggaguuccgccuguggcaguucguccucaaccugcggcuguacgaccgcaccgaggacaaggaggugaccgcggaguaccuccccagcaaggaggacuacgcccggcuguucguguaccugaacgaccgcaaggagaucaaccaggagacgcugcucaaggacuucuucaagcugaagaaggucaagcagcgguccgagaaggacuuccccgugcgcuggaacuacaucgaggacaaggagaagaaguaccccugcaacgagacccggcacgagcugcucauggcccuggaccgcgccggcaucgagcggagcuggcuggacgacaccgcgcgccaguaccgccucuggcaccuccuguacuccaucgaggugaaggacgaggccgagcgggcccugcgcaagcugaaggacgacgacgaguucgucagcgccuuccugaaggugaagccguucaagaaggacuacggggccuacuccgagaaggcggugaagaagcuccuggccgucaugcggaugggcagccacuggugcgaggacgacaucugcaaggagaccaaggagcgcaucgagcacauccugcagggggacgugggcgagaagaucaaggagcggaugaaccacacggccuacucccucggggagcugagcgacuuccaggcccugcccgaguggcucgcgugcuacgucguguacggccgccacuccgaggccaccgacaucaagcacuggaagacccccgagagccugauggccuacaucaacggcuucaagcagcacucccugcggaaccccaucguggagcagugcauccucgagacccugcgcacgguccacgacaucuggaaggaggccgggcacaucgacgagauccacguggagcugggccggagcaugaaguccaccagcgaccagcgcgcccggaugaccgagaacauccuccgcaacgagaacaccaaccugcggaucaagucccugcucauggagcugaagaacgacgcggacaucaaggacgugcgcccguacagccccaugcagcaggagauccugcggaucuacgaggagggggcccuccaggagcugacgaaggaggacaacgacuacgaggagaucuucaagaucuccaagaugccccagcccagcgccaaggagcugcucaaguacaagcuguggcuggagcagaaguaccgcuccccguacaccggcaagcccaucagccucagcaagcuguucaccuccgccuaccagaucgagcacaucaucccccagagccgguacuucgacgacuccuucaacaacaaggucaucugcgagagcgaggugaacgcccugaagggcaacaugcucggguacgaguucaucaagaaccacggcggggagaucgugcacugcacccugcugggcgacgucaaggugcagaacgaguccgaguacaaggcguucgugacggagcacuacgccaacaacaaguacaagaaggagaagcuccugauggaggacaucccgcaggacuuccugaaccgccaccucaacgacagccgguacaucuccaaggucgugaagacccugcugagcaacaucgugcgcaccgaggacgagauggagaccaccuccaaguucgucgugagcugcaccgggggcaucacggaccggcucaagaaggacuggggccugaacgacguguggaacuccaucgucuacagccgcuucgagcgccugaacgagcucaccaaguccgacgccuucgggcggugggagaacaaggagggcaagcgcguguuccagaccagcgugccccuggagcugcagcggggguucaacaagaagcgcaucgaccaccggcaccacgccauggacgcccucgucaucgcgugcgccucccgcaacaucaucaacuaccugaacaacgagagcgccaacucccccaagaagcgggaggaccugcgccagcagcucugcgacaagaaccggaucauccgcaagcccugggagagcuucacgcaggacgcccgggcggcccuggaggacgugguggucagcuucaagaacuacgugcgcgugaucaacaaggccaccaacuacuacgagcgguacgacgccgacggcaagaagaccaucaccaagcagaagucccgcgagaugugggccguccggaagccgaugcacaaggagacgguguucgggcacgugaaccugcgccggaaggcgaucgucaagcucaaggacgcccuggagaacauccccagcaucugcaacaaggagcugcgcgacuacaucaacggccucguggagcggaacuucaacaccaagcagcugcacgcccacuuccgcuccaccgacuaccgcuggaacaagcagaacguggacaaggucgagguguggcgguucagcgacgagaaggagccccugguggccacccgcaagccccucgacacguccuucgacgccaagcggaucgacaccaucaccgacaccggcauccagaagauccugcugaacuaccucgaggcgaagggcggggacccgcugaucgccuucacgcccgaggggaucgccgagaugaaccagaacaucgcccuguacaacgacggcaagaugcaccagcccauccucaagguccgcaucagcgagcccaagggggccaaguaccagaucggccagaccggcaacaaggcggacaaguucguggaggcccagaaggggaccaaccuguacuucgccaucuacgaggacgaggaccggaaccgcaccuacaacacgaucccgcugaacgagguggccgagcggcucaagcagggccugccgcccguccccgagaagaacgagaaggaggugccccugaaguucuaccucucccccaacgaccugguguacguccccaccgaggaggagauccugaugaaggagugcaagcucaacaagaaccgcaucuacaagauggugagcuccaccgggaaccagugcuucuucauccccuuccggguggcggucagcaucgugaacaagauggaguacuccccgcugaacaagauggagaaggccaucagcuccgagaugaucaaggccgugugcuggaagcuggaggucgaccgccucggcaacaucauccggguggugaaguga

SEQ ID NO: 2242 - RNA, 4458 nt, Artificial Sequence
  Cas9 variant
augaagaacauccugggccucgaccuggggaccaacagcaucggcugggccaagaucuccaucgacgacaacgggaaguacaucaaggacagcaucaagcugggcucccgcaucauccccaugagccaggacgugcucuccaacuucagcaagggggucacccugucccagacgagcgagcggaccuccuuccgcggcgcccggcgccugcgggagcgcacccuccugcggcgcgagcggcugcaccgcauccuccaccuccugggcuuccucccgaagcacuacgagaaggcgaucgggugggaccggaacgacaacaagaccuacggcaaguucaucaaccacgccgagcccaagcuggccuggugcaaggacaacaacgggaagaugcgcuuccuguucauggacagcuuccacgacaugcucuccgaguucagcgagaagcaccccgagcugcuggccaacggcaagaagaucccccucgacuggacgaucuacuaccugcggaagaaggcccuguacaaggcgaucaccaaggaggagcucgccuggauccugcugaacuucaaccagaagcgcggguacuaccagcuccggggcgaggaggaccgcgacuccgaggccaacaagaaggaguaccuggagcugaaggugaucggcguggaggccaccggggagaagaagggcaacgacaucugguacaacauccaccucgagaacggguggaucuaccggcgcagcuccaagaacccgcugaacgacuggcugggcaaggucaagagcuucaucgugaccacggaccucgacgcggacggcaaccccaagaaggacaaggacgggaacaucaagcgguccuuccgcgcccccagcgagggcgacuggacccugaucaagaagcggaccgagucccugcucgagaacagcgggcagaccgugggccaguucaucuacaaccacauccuggaggagcccagcgccaagauccgcgggaacuucauccgcacgaucgagcggaaguacuacaaggacgagcugaaggccauccucgagaagcagaaggaguuccaccacgagcuguccagcgagucccugcucaccgagugcgccaaggagcuguacaagcgcaacaucgcgcaccaggagguccugcucaagaagggcaugauccaccuccugcugaacgacauccuguucuaccagcggccgcugaagaucaagaagucccucaucgacaacugccccuacgagaacuacaaguacguggacaagaaguccggcgacaucaaggucaagagcaucaagugcaucgccaagagcaaccccuucuuccaggaguuccgccuguggcaguucgugagcaaccugcggcuguaccgcaaguccgacgacaaggacgugaccagcgagcaccucgugaccacggacgacuacgccaaccuguucaccuaccugaacaaccggaaggacaucaagcaguccguccuccugaaggaguacuucaagaucaagaaggugaagaccaucaacggggccgaguaccccgugcgcuggaacuacaucgacgacgacaacaagaccuacccgugcaacgagacgcgguacgacauccugcacgcccucagcaagaccgagcugaaguccgaguggcugacccccgagcgcaccuaccggcucuggcaccuccuguacagcaucgaguccaaggaggagacgaagaaggcgcugaacaagcugaaccugagcgacgacuucaccgaggccuuccucaccaucaagcccuucaagaaggaguacggcuccuacagcgagaaggccaucaagaagcugcugucccucaugcgcaugggguaccuguggagcgaggacgaggccaucaagcaggucggcgccgagaucgagaagaccaucgagggggagcugcccgacuacgugcuccagcggcuggagaagucccagcacaacuacaacaagaucagcgacuucagcggccugccgcucuggcuggcguccuacaucaucuacggccgccacagcgaggccaaggagaucauccacugggacaaccccgaguccaugauggccuacaucaaggacuuccggcagcacagcaugcgcaaccccaucguggagcagugcguccuggagacgcuccggaccgugcacgacaucuggaaggagaucgggcacaucgacgagauccacaucgagcugggccgcgagaugaaguccaccagcgagcagcggaaggccaucacccagaacgugcugcacaaccagaacacgaacauccgcaucaagcuccugcugcaggagcucaagaacgacaacaacaucaccgggguccgccccuacuccccgaugcagcaggagauccugcggaucuacgaggagggcgcccugcaggggcucaccaaggaggacaaggacuacaacgacauccugaagaucagccagaccgcgcagcccacguccaacgagcugacccgcuacaagcucuggcuggagcagaaguaccggagccccuacaccggcaaggccaucucccugagcaagcuguucaccuccgccuaccagaucgagcacgugaucccccagagccgcuacuucgacgacucccugagcaacaaggugaucugcgagagcgaggucaacacccugaagaaggccaugcucggcauggaguucaucaagacgugcgggggccagaaggugcacugcacccugcugggggacgucgagaucuacaacgaggaggacuacaaggcguucgugaacgagcacuacuccaacaaccggaccaagcgcaacaagcuccugauggaggacaucccgcaggaguucaucaaccggcagcugaacgacagccgcuacaucuccaagauggugaagcagcuccugagcgccaucguccggggccaggaggagguggaggccaccuccaaguucgugauccccugcacgggcgggaucaccgaccgccugaagaaggacuggggccucaacgacaucuggaacaaccuggucagcccccgguuccagcgcaugaacgcccugaccggguccgaguacuucggccacugggagaacaaggaggggaagcggguguuccagaccacgaugcccauccagcuccagcagggcuucagcaagaagcgcaucgaccaccggcaccacgccauggacgcgcuggugaucgccugcgccucccgcaacaucaucagcuaccugaacaacgagaccgcccaggacaccgagcggcgccgggaccuccgccagaagcugugcgacaagggcggguccguccggaagccgugggacagcuucacccaggacacgcaguacgcccugaaggacaucaucgugaccuucaagaacuacgugcgcaucaucaacaaggcgaccaacuacuacgagcacuacaagaccgacggcaagaaggggaugaucucccagaagggcgacgagcucugggccauccgcaagcccaugcacaaggagacggucuucgggaaggugaaccugcggcgccccaagcgggugagccuguccaaggccaucgacagcgucgacgugaucugcaaccgcaagcucaagaaguacaucaaggcccggcugaacgagggccugcagaagaagcagauccucaacaucuucaaggaggugaacaacgucugggagggcaucgacgugaacaagaucgacaucugggagauguccaacgacaaggagccgaugguggccacccgcaagcagcuggacaccagcuucgacgagaagaagauccgguccaucagcgacaccgggauccagaagauccugcucaacuaccugaucacgaagaacaacaaccccgagcuggcguucacccccgagggcauccaggagaugaacagcaacaucuccgaguacaacgaccacaagaagcaccagcccaucuacaagguccgcgugaccgagccgcucggggccaaguaccccaucggcaccauggggaacaaccccaagaaguucguggaggcccaggccggcacgaaccuguacuucgcgaucuacgaggacaaggagggcaaccggaacuacgacaccaucccccugaacaucgccgccgagcgccucaaccagcagcugagcccgguccccgagaccaacgagaacaacacgccccugaaguucuaccucucccccaacgaccugguguacgugccgagcgaggaggagcggcacuccgggaacaacauccagcuggacaagaaccgcaucuacaagauggucagcuccaccagcaagcagugcuucuucauccaccaccggguggccaucucccucguggacaagaaggaguucagcgcccagaacaagauggagcgcuccaucgacaacgagcaggucaugaucaagagcgugugcuggaagcugaucaccgaccggcugggcaacaucaucaaggugaucaaguga

SEQ ID NO: 2243 - RNA, 4458 nt, Artificial Sequence
  Cas9 variant
augaagaacauccugggccucgaccuggggaccaacagcaucggcugggccaagaucuccaucgacgacaacgggaaguacaucaaggacagcaucaagcugggcucccgcaucauccccaugagccaggacgugcucuccaacuucagcaagggggucacccugucccagacgagcgagcggaccuccuuccgcggcgcccggcgccugcgggagcgcacccuccugcggcgcgagcggcugcaccgcauccuccaccuccugggcuuccucccgaagcacuacgagaaggcgaucgggugggaccggaacgacaacaagaccuacggcaaguucaucaaccacgccgagcccaagcuggccuggugcaaggacaacaacgggaagaugcgcuuccuguucauggacagcuuccacgacaugcucuccgaguucagcgagaagcaccccgagcugcuggccaacggcaagaagaucccccucgacuggacgaucuacuaccugcggaagaaggcccuguacaaggcgaucaccaaggaggagcucgccuggauccugcugaacuucaaccagaagcgcggguacuaccagcuccggggcgaggaggaccgcgacuccgaggccaacaagaaggaguaccuggagcugaaggugaucggcguggaggccaccggggagaagaagggcaacgacaucugguacaacauccaccucgagaacggguggaucuaccggcgcagcuccaagaacccgcugaacgacuggcugggcaaggucaagagcuucaucgugaccacggaccucgacgcggacggcaaccccaagaaggacaaggacgggaacaucaagcgguccuuccgcgcccccagcgagggcgacuggacccugaucaagaagcggaccgagucccugcucgagaacagcgggcagaccgugggccaguucaucuacaaccacauccuggaggagcccagcgccaagauccgcgggaacuucauccgcacgaucgagcggaaguacuacaaggacgagcugaaggccauccucgagaagcagaaggaguuccaccacgagcuguccagcgagucccugcucaccgagugcgccaaggagcuguacaagcgcaacaucgcgcaccaggagguccugcucaagaagggcaucauccaccuccugcugaacgacauccuguucuaccagcggccgcugaagaucaagaagucccucaucgacaacugccccuacgagaacuacaaguacguggacaagaaguccggcgacaucaaggucaagagcaucaagugcaucgccaagagcaaccccuucuuccaggaguuccgccuguggcaguucgugagcaaccugcggcuguaccgcaaguccgacgacaaggacgugaccagcgagcaccucgugaccacggacgacuacgccaaccuguucaccuaccugaacaaccggaaggacaucaagcaguccguccuccugaaggaguacuucaagaucaagaaggugaagaccaucaacggggccgaguaccccgugcgcuggaacuacaucgacgacgacaacaagaccuacccgugcaacgagacgcgguacgacauccugcacgcccucagcaagaccgagcugaaguccgaguggcugacccccgagcgcaccuaccggcucuggcaccuccuguacagcaucgaguccaaggaggagacgaagaaggcgcugaacaagcugaaccugagcgacgacuucaccgaggccuuccucaccaucaagcccuucaagaaggaguacggcuccuacagcgagaaggccaucaagaagcugcugucccucaugcgcaugggguaccuguggagcgaggacgaggccaucaagcaggucggcgccgagaucgagaagaccaucgagggggagcugcccgacuacgugcuccagcggcuggagaagucccagcacaacuacaacaagaucagcgacuucagcggccugccgcucuggcuggcguccuacaucaucuacggccgccacagcgaggccaaggagaucauccacugggacaaccccgaguccaugauggccuacaucaaggacuuccggcagcacagcaugcgcaaccccaucguggagcagugcguccuggagacgcuccggaccgugcacgacaucuggaaggagaucgggcacaucgacgagauccacaucgagcugggccgcgagaugaaguccaccagcgagcagcggaaggccaucacccagaacgugcugcacaaccagaacacgaacauccgcaucaagcuccugcugcaggagcucaagaacgacaacaacaucaccgggguccgccccuacuccccgaugcagcaggagauccugcggaucuacgaggagggcgcccugcaggggcucaccaaggaggacaaggacuacaacgacauccugaagaucagccagaccgcgcagcccacguccaacgagcugacccgcuacaagcucuggcuggagcagaaguaccggagccccuacaccggcaaggccaucucccugagcaagcuguucaccuccgccuaccagaucgagcacgugaucccccagagccgcuacuucgacgacucccugagcaacaaggugaucugcgagagcgaggucaacacccugaagaaggccaugcucggcauggaguucaucaagacgugcgggggccagaaggugcacugcacccugcugggggacgucgagaucuacaacgaggaggacuacaaggcguucgugaacgagcacuacuccaacaaccggaccaagcgcaacaagcuccugauggaggacaucccgcaggaguucaucaaccggcagcugaacgacagccgcuacaucuccaagauggugaagcagcuccugagcgccaucguccggggccaggaggagguggaggccaccuccaaguucgugauccccugcacgggcgggaucaccgaccgccugaagaaggacuggggccucaacgacaucuggaacaaccuggucagcccccgguuccagcgcaugaacgcccugaccggguccgaguacuucggccacugggagaacaaggaggggaagcggguguuccagaccacgaugcccauccagcuccagcagggcuucagcaagaagcgcaucgaccaccggcaccacgccauggacgcgcuggugaucgccugcgccucccgcaacaucaucagcuaccugaacaacgagaccgcccaggacaccgagcggcgccgggaccuccgccagaagcugugcgacaagggcggguccguccggaagccgugggacagcuucacccaggacacgcaguacgcccugaaggacaucaucgugaccuucaagaacuacgugcgcaucaucaacaaggcgaccaacuacuacgagcacuacaagaccgacggcaagaaggggaugaucucccagaagggcgacgagcucugggccauccgcaagcccaugcacaaggagacggucuucgggaaggugaaccugcggcgccccaagcgggugagccuguccaaggccaucgacagcgucgacaucaucugcaaccgcaagcucaagaaguacaucaaggcccggcugaacgagggccugcagaagaagcagauccucaacaucuucaaggagcugaacaacgugugggagggcaucgacgugaacaagaucgacaucugggagauguccaacgacaaggagccgauggucgccacccgcaagcagcuggacaccagcuucgacgagaagaagauccgguccaucagcgacaccgggauccagaagauccuccugaacuaccugaucacgaagaacaacaaccccgagcucgcguucacccccgagggcauccaggagaugaacagcaacaucuccgaguacaacgaccacaagaagcaccagcccaucuacaaggugcgcgugaccgagccgcugggggccaaguaccccaucggcaccauggggaacaaccccaagaaguucgucgaggcccaggccggcacgaaccuguacuucgcgaucuacgaggacaaggagggcaagcggaacuacgacaccaucccccucaacaucgccgccgagcgccugaaccagcagcugagcccggugcccgagaccaacgagaacaacacgccccucaaguucuaccugucccccaacgaccugguguacgucccgagcgaggaggagcggcacuccgggaacaacauccagcucgacaagaaccgcaucuacaagauggugagcuccaccagcaagcggugcuucuucauccaccaccgcguggccaucucccuggucgacaagaaggaguucagcgcccagaacaagauggagcgguccaucgacaacgagcaggucaugaucaagagcgugugcuggaagcugaucaccgaccgccucggcaacaucaucaaggugaucaaguga

SEQ ID NO: 2244 - RNA, 4458 nt, Artificial Sequence
  Cas9 variant
augaagaacauccugggccucgaccuggggaccaacagcaucggcugggccaagaucuccaucgacgacaacgggaaguacaucaaggacagcaucaagcugggcucccgcaucauccccaugagccaggacgugcucuccaacuucagcaagggggucacccugucccagacgagcgagcggaccuccuuccgcggcgcccggcgccugcgggagcgcacccuccugcggcgcgagcggcugcaccgcauccuccaccuccugggcuuccucccgaagcacuacgagaaggcgaucgggugggaccggaacgacaacaagaccuacggcaaguucaucaaccacgccgagcccaagcuggccuggugcaaggacaacaacgggaagaugcgcuuccuguucauggacagcuuccacgacaugcucuccgaguucagcgagaagcaccccgagcugcuggccaacggcaagaagaucccccucgacuggacgaucuacuaccugcggaagaaggcccuguacaaggcgaucaccaaggaggagcucgccuggauccugcugaacuucaaccagaagcgcggguacuaccagcuccggggcgaggaggaccgcgacuccgaggccaacaagaaggaguaccuggagcugaaggugaucggcguggaggccaccggggagaagaagggcaacgacaucugguacaacauccaccucgagaacggguggaucuaccggcgcagcuccaagaacccgcugaacgacuggcugggcaaggucaagagcuucaucgugaccacggaccucgacgcggacggcaaccccaagaaggacaaggacgggaacaucaagcgguccuuccgcgcccccagcgagggcgacuggacccugaucaagaagcggaccgagucccugcucgagaacagcgggcagaccgugggccaguucaucuacaaccacauccuggaggagcccagcgccaagauccgcgggaacuucauccgcacgaucgagcggaaguacuacaaggacgagcugaaggccauccucgagaagcagaaggaguuccaccacgagcuguccagcgagucccugcucaccgagugcgccaaggagcuguacaagcgcaacaucgcgcaccaggagguccugcucaagaagggcaugauccaccuccugcugaacgacauccuguucuaccagcggccgcugaagaucaagaagucccucaucgacaacugccccuacgagaacuacaaguacguggacaagaaguccggcgacaucaaggucaagagcaucaagugcaucgccaagagcaaccccuucuuccaggaguuccgccuguggcaguucgugagcaaccugcggcuguaccgcaaguccgacgacaaggacgugaccagcgagcaccucgugaccacggacgacuacgccaaccuguucaccuaccugaacaaccggaaggacaucaagcaguccguccuccugaaggaguacuucaagaucaagaaggugaagaccaucaacggggccgaguaccccgugcgcuggaacuacaucgacgacgacaacaagaccuacccgugcaacgagacgcgguacgacauccugcacgcccucagcaagaccgagcugaaguccgaguggcugacccccgagcgcaccuaccggcucuggcaccuccuguacagcaucgaguccaaggaggagacgaagaaggcgcugaacaagcugaaccugagcgacgacuucaccgaggccuuccucaccaucaagcccuucaagaaggaguacggcuccuacagcgagaaggccaucaagaagcugcugucccucaugcgcaugggguaccuguggagcgaggacgaggccaucaagcaggucggcgccgagaucgagaagaccaucgagggggagcugcccgacuacgugcuccagcggcuggagaagucccagcacaacuacaacaagaucagcgacuucagcggccugccgcucuggcuggcguccuacaucaucuacggccgccacagcgaggccaaggagaucauccacugggacaaccccgaguccaugauggccuacaucaaggacuuccggcagcacagcaugcgcaaccccaucguggagcagugcguccuggagacgcuccggaccgugcacgacaucuggaaggagaucgggcacaucgacgagauccacaucgagcugggccgcgagaugaaguccaccagcgagcagcggaaggccaucacccagaacgugcugcacaaccagaacacgaacauccgcaucaagcuccugcugcaggagcucaagaacgacaacaacaucaccgggguccgccccuacuccccgaugcagcaggagauccugcggaucuacgaggagggcgcccugcaggggcucaccaaggaggacaaggacuacaacgacauccugaagaucagccagaccgcgcagcccacguccaacgagcugacccgcuacaagcucuggcuggagcagaaguaccggagccccuacaccggcaaggccaucucccugagcaagcuguucaccuccgccuaccagaucgagcacgugaucccccagagccgcuacuucgacgacucccugagcaacaaggugaucugcgagagcgaggucaacacccugaagaaggccaugcucggcauggaguucaucaagacgugcgggggccagaaggugcacugcacccugcugggggacgucgagaucuacaacgaggaggacuacaaggcguucgugaacgagcacuacuccaacaaccggaccaagcgcaacaagcuccugauggaggacaucccgcaggaguucaucaaccggcagcugaacgacagccgcuacaucuccaagauggugaagcagcuccugagcgccaucguccggggccaggaggagguggaggccaccuccaaguucgugauccccugcacgggcgggaucaccgaccgccugaagaaggacuggggccucaacgacaucuggaacaaccuggucagcccccgguuccagcgcaugaacgcccugaccggguccgaguacuucggccacugggagaacaaggaggggaagcggguguuccagaccacgaugcccauccagcuccagcagggcuucagcaagaagcgcaucgaccaccggcaccacgccauggacgcgcuggugaucgccugcgccucccgcaacaucaucagcuaccugaacaacgagaccgcccaggacaccgagcggcgccgggaccuccgccagaagcugugcgacaagggcggguccguccggaagccgugggacagcuucacccaggacacgcaguacgcccugaaggacaucaucgugaccuucaagaacuacgugcgcaucaucaacaaggcgaccaacuacuacgagcacuacaagaccgacggcaagaaggggaugaucucccagaagggcgacgagcucugggccauccgcaagcccaugcacaaggagacggucuucgggaaggugaaccugcggcgccccaagcgggugagccuguccaaggccaucgacagcgucgacgugaucugcaaccgcaagcucaagaaguacaucaaggcccggcugaacgagggccugcagaagaagcagauccucaacaucuucaaggagcugaacaacgugugggagggcaucgacgucaacaagaucgacaucugggagauguccaacgacaaggagccgaugguggccacccgcaagcagcuggacaccagcuucgacgagaagaagauccgguccaucagcgacaccgggauccagaagauccuccugaacuaccugaucacgaagaacaacaaccccgagcucgcguucacccccgagggcauccaggagaugaacagcaacaucuccgaguacaacgaccacaaggagcaccagcccaucuacaaggugcgcgucaccgagccgcugggggccaaguaccccaucggcaccauggggaacaagcccaagaaguucguggaggcccaggccggcacgaaccuguacuucgcgaucuacgaggacaaggagggcaaccggaacuacgacaccaucccccucaacaucgccgccgagcgccugaaccagcagcugagcccggugcccgagaccaacgagaacaacacgccccucaaguucuaccugucccccaacgaccuggucuacgugccgagcgaggaggagcggcacuccgggaacaacauccagcucgacaagaaccgcaucuacaagauggugagcuccaccagcaagcagugcuucuucauccaccaccgggucgccaucucccugguggacaagaaggaguucagcgcccagaacaagauggagcgcuccaucgacaacgagcaggucaugaucaagagcgugugcuggaagcugaucaccgaccggcucggcaacaucaucaaggugaucaaguga

SEQ ID NO: 2245 - RNA, 4461 nt, Artificial Sequence
  Cas9 variant
augaccaagauccugggccucgaccuggggaccaacagcaucggcugggccauccgcgaggacgagaacgagggggugaaccagaucaucgacaagggcguccggaucuucuccgagggggucaagagcgagaacggcaaggagaucucccgcgccgcggagcggacggccuaccgcagcgcccggaagaucaaguaccgccggaagcugcgcaaguacgagacccucaaggugcuguccgugaacggcaugugcccccugagcguggaggagguggagcaguggaagaaguccggguucaaggaguacccgcucaaccccgaguuccugaacuggcugcggaccaacgaggacaagaacaucaaccccuacuucuuccgcgacaaggccagcaagcagaaggucacccucuucgagcugggccgggcccuguaccacaucgcgcagcgccggggguuccucuccaaccgccuggaccagagcgccgagggcguguucgaggagcacaacccccagauccagaaccugaucgaggaccucgacuccagcaacacgauccugaacgagcugaaggaguacuacaucaaccucgggaucaucgacgaguccgagaaguccggcuucaagaaggaccuggacgagggcgagaagaaccugaagaagcucuacaccucccuggugagcaucaccaagaagaacgccaacgacaucgagaccugcaagcaggagcugaucgcccggcucaacaagaaggaggaccuggggaaggucaagggcgagaucaaggacaucucccaggcgaugcuggacgggaacuucaagacgcucggccaguacuucuucagccuguacaacaagacccgcauccggaaccaguacaccucccgcgaggagcacuaccuggaggaguucaucaucaucugccagacccagggcaucgaggagaucaacacgaacgagaagcucccggagaagaaguucaccgggcuggccaaggaccuguaccgggccaucuucuuccagcgcccccucaagagccagaagggccugaucgggaagugcagcuucgagaagaacaagucccggugcgccgugagccaccccgacuacgaggaguuccgcaugugguccuaccugaacaccaucaagaucggcacccagagcgagaagacgcuccgcuuccugacccuggaggagaagcucaagcuggugcccaaguucuaccggaagaacgacuucaacuucgagguccuggccaaggagcucguggagaagggggcguccuucggcuacuacaagagcuccaagaagaacgaguucuucuacugguucaacuacaagccgaccgacagcguguccgccugcgucgugagcgccucccuggagaacgccaucggcaaggacuggaagaccaagacguucgaguaccagaccagcaacaccaagaaggaggaggugaccaaguccgucaacuacaaggaccuguggcaccuccugagcguggccacguccgacaccuaccuguacgacuucgcgaucgagaagcucaagcuggagcccaagaacgccaaggccuucagcaagaccaagcugaagaaggacuucgccucccugagccucgccgcgaucgccaagauccugcccuaccugaagcaggggcuccuguacucccacgccguguucaucgccaacaucgagaacaucgucgacgccgacaucuggaaggacaaggagcagcagaaguucauccagagcaagaucguggaccugaucgacaacuaccucguggagaaguccaagcuggagaucaucaacugccugcucaagaucuacaacaccgaggacaucgagggccgcaaggucuacuacagcaaggaggcggagagccuguucgaggccgaccugcggaagaagcucgugcccuucuacaaggccaacacgaucuccgagcagcaggagcaggagaucaucuucaaggaccuguucccgguccugaucgagcagcucaagaagcaggaguucaucaagaucgugcgccuggacaagaagaucgaggccuuccugaagggggagaacgaggagggccagaucuucugcaacuaccccgagaaguucaagaagcucuaccaccccagcgacaucgagguguucaagaagaagaucaucaaggacgagugggggaacgagaaggucgugcugggcagcccccugaccaccagcaucaagaacccgauggcgaugcgggcccuccaccagcugcgcaaggugcugaacacccucauccuggacggccagaucgacgagaagacgcggauccacaucgagauggcccgcgagcugaacgacgccaacaagcggaaggggauccaggacuuccagaaggagcgcgaggagcucuacaagaucuacgaggccaagaucaaggagcuguaccaggucaagaccggcaaggagcugcuccacgugaccgacgaggaccugcagaaguucgagugggcgcuggagcagaccaaggacgggcggaucaucacgaaggaggagcucaucaaguacaagaucugggaggagcagaaccacaucugcaucuacaccggcaagaccaucuccaucgacagcuuccucgggggcaaccccaaguucgacaucgagcacaccaucccccgcuccaucagccaggacaacucccugaugaacaagacccugugcgacaaggacuucaaccggagcgugaagggcaagaagaugcccgucgagcuguccaacuacaacgagauccugccgcgcaucgcccacuggaagaagcaggccgaggagcucacgcggcagaucgagaccaucagccgcuccaucaagagcgccgccaccaagguggcgaaggacaagaacauccggaagcgccacuaccugacccugaagcgggacuacauccaggggaaguacgaccgcuucacguggggcgagcccaaggugggguucaagaacucccagauccccgacaccggcaucaucaccaaguacgcccaggccuaccucaagagcuacuucaagcgcgucgagagcgugaagggcggggccguggccgaguuccggaagcuguggggcauccaggaguccuucaucgacgagaacggguucaagcacuucaaggagaaggaccgcagcaagcacacccaccacacgaucgacgcgaucaccaucgccugcaugcccaaggacaaguacgaccugcucgcccacgccuggcggcuggaggacgagcagaacaagaaggcggccaaggcccugaucgagcaggccaagccguggaagaccuucaaggaggacaucgagaagaucgaggccgagauccucgucucccacuucacccccgacaacgugaagaagcaggcgaagaagauccugcgcgugcggggcaagaagcaguacgucgccgagaucgagcgcaacgccaacgggaaggccauccccaagaaggacgccagcggcaagaucaucuacaagcugaacgagcggggcaacaagauccccauccuccagcagggggacacgauccgcggcucccugcaccaggacagcaucuacggggcgaucaagaacccgcugaacaccaacgagauccgguacgugauccgcaaggaccucgagucccugaaggccaacgacaucgagaacaucguggacgagaacgucaaggccaaggugaaggaggccguggccaacaagauccugcucaucagcuccaacccccagcagaagaacaaguucgcggagggcaagaacgucuggaugaacgaggagaagaagauccccaucaacaaggugcggaucuacgccaacagcgugaagaacccgaucgagaucaagaagcacuccacccugagcaaguccaagcacgagcacaagcagaccgucuacgggcagaacgacgagaacuacgccauggcccuguacgagcucgacggcaagcgcgaguucgagcugaucaacaacuucaaccuggcgaagcuccugaagcagggccagggguacuacccccugcacaaggagaaggagaucaagggcaagaaggugcucauccccaucgagaagcggaacaaccgcgacgugguccugaagcgggggcagcaggucguguucuacgacaagacgguggagaacagcaaggacaucuccgagaucguggacuuccgcggccggguguaccugaucgaggggcucaccauccagcgccagaaggacaagaagaccggcaaggucaacgaguacggcaucauccagcugcgguacuucaaggaggcccgcaagagcgaggagaucuccaaggacagcuucaagcccgacggggaguucaagaucaacgagaacaagccgacccggaagaugaaccacaaccaguucacggccuucguggagggcaucgacuucaaggugcugcccuccgggaaguuccagaagaucuga

SEQ ID NO: 2246 - RNA, 4464 nt, Artificial Sequence
  Cas9 variant
augaagaacgugcugggccucgaccuggggagcaacuccgucggcugggcccuggugaagaccgaggacaacgggaaccccaucggcagcaucaagauggggucccgcaucaucccgaugagccaggacauccucggcuccuucgagaagggcgacaccgugagccagacggcccagcggacccuguaccgcgggaagcggcgccugaucgagcggcacguccuccgccgggagcgccugugccgggugcugcacaucaugaacuuccuccccgaccacuucgacaagcugcugggcugggacaagaccgacaacaagaccuacgggaaguucaucgacgacuccgagcccaagcucgcguggcgccagaacaagaacgagaaggagaagauggaguucguguucauggacagcuuccacgagaugcuguccgacuucgccaagcaccagccccagcugaucgccaacggcaagaaggucccgcucgacuggacgaucuacuaccugcggaagaaggcccugacccagcucaucagcaaggaggagcuggccuggauccugcucaacuucaacaagaagcgcggguacuaccagcugcggggcgaggaggaggaggagcagcccaccaagaaggaggaguacaaggugcugaaggugaucuccgucgacgcggacgagggccagaaggggaacggcaucugguacaacauccaccucgaggacgggggcaucuacaagcgcaagagcgacacgccccuguacgacugggugggcaagacccugcagcucaucguggucaccaucuacgagaaggacgggaagacccccaagaucuucgacuccggcaagcagaacccgagcuaccggcugcccaaggaggacgacugggggcugaucaagaagcgcaccgagucccagauccagagcuccggcaagacggugggggccuucaucuacgacaacauccucagcaagcccgacgacaagauccggggcaaccuggugcgcaccaucgagcggaaguacuacaagaaggagcugaucgagauccuccagcagcaggccaaguaccacgacgagcugcacaaccagaaccugcucgaguccugcgccaaggagcuguacgcgcacaacgacguccgcuacaacgagguggucaagagcaacaugauccaccuccugguggacgacaucaucuucuaccagcggccccucaagagcaagaagucccugaucgccaacugcaaguacgagagcuacgaguacguggacaaggagaccggcgaggugaaggagaugccgaucaagugcaucgccaaguccaaccccuacuaccaggaguuccgccuguggcaguucauccacaaccugcgccugagcgacgucgugacccgggaggacgugacggcccaguaccucuccacgccccaggacuacugcaaccuguucaccuaccugaacgaccgcaaggagaucaagcaggacauccuccugaaggacuucuucaagaucaagaagguccagaucgacaaggagaagguguuccccaucgaguggaacuacaucaaggacgccaccaagaccuacccgugcaacgagacccgguacgagcugcugagcgcgcucaagcgcgccgggauggacaagcaguggcuggacgacacccccaacaugcaguaccggcuguggcaccuccuguacuccgucgaggagcaggaggagagcgccaaggcccugcgcaagcucuacgacaacgacaacuucguguccagcuuccugaagaucaagcccuucaagaagugcuacggcgccuacuccgagaaggcgaucaagcggcugcucacccugaugcgcauggggaaggccugggacgagcaggccaucgacgccaagacgcugaagugcauccagcagaucaucaccggcaacaucgacagcaagcucaaggagaagaucgacgacucccgguacgugcugcaccacgucagcgacuuccaggggcugcccaccuaccucgccuccuacgugaucuacggccgccacagcgaggugaccgacauccggugcugggacacgccgaaggaccugcugaaguucaucugcggcuucccccagcacucccuccgcaaccccaucgucgagcaggucauccuggagacccugcgggugguguacgacaucuggaaggcggagaagcacaucgacgagauccacguggagguggcccgcgagaugaagcucaccgcccagcagcggaacgaggccaaccugcgcaaccugaacaacgaggccaccaaccuccggaucaaguaccugcuggaggagcucaagaacgacacguucaucaaggacguccgcccccugagcccgaugcaccaggagaagaugcggaucuacgagcaggcggugcuggggaaccucaacaagcaggacaaggacuacgacgacaucaucaagaucuccaagaaggagcgccccaccagcgccgagcugauccgcuacaagcuguggcucgagcagaaguacugcagccccuacaccggcaaggccaucucccugagcaagcuguucaccacggccuaccagaucgagcacgugaucccccagucccgguacuucgacaacagcuucaacaacaaggucaucugcgaguccgaggugaacaaggagaaggacaagaugcucggguacgaguucaucaagggccgcgggggcgaccggaucuacugcaccgcgcacggcaaggaggugaccauccugaaggaggaggaguacaagcaguucgucaacgagcacuacgcccacaacaagcgcaagcgggacaaccugcucgccgagaacaucccggagagcuucuccagccgccagcugaacgacacccgguacaucaccaagacgaucaugucccugcucagcaacguggugcgccagcagggggaggaggaggccaccgccaagaaccugcugcccuccagcggcgcggucaccgacaagcucaagaacgacugggggcugaaggacguguggaacaccaucgugacgccccgguucgagcgccugaacaagcucuccggcaccaacgacuucggcgagaugaaggaggagaacgggaaccgguacuuccagaccaacgucccgagcgaguacgagaagggcuucaagaagaagcgcaucgaccaccggcaccacgccauggacgcccuggugaucgccugcaccacgcgcaacauggugaacuacaucuccaacgucaacgccaacagccccaagcagcgggaggaccugcgccagcuccugugcgacaagaaccggaucaucaacaagcccuggaacaccuucacccaggacgcgcugaaggcccucaacgacaucgugguguccuucaagaacaacguccgcaucaucaaccgggccaccaaccgcuaccagcgguacgacaagaacgggaagaagaugaucugcagccagaagggcaacgacaugugggccauccgcaagagcaugcacaaggagacgguguucgggcgcgugaaccugauccggaaggaggcccugcccaucgcgaaggcccucgacaacaucuccgccaucugcaacgcccagcugcgcgcguacgucaacgaccugguggacaagcacuucaacaagaagcagcucguggcccacuucaagagccuggacuacaaguggaaccggcaggacgucuccaagguggagguguggaucagcuccgacgacaagaccccgauggucgccgugcgcaagccccuggacaccagcuucgacaagaagaagaucgccuccaucaccgacacgggcauccaggccauccuccugaacuaccuggagagcaagggcggggacgcgcucguggccuucgcccccgagggcauccaggagaugaacuccaacaucgagcuguacaacaacgggaaggcccacaagcccaucaagaacguccggcugagcgagacccucggcgccaaguaccaggugggggagcgcggcgcgaagaccaagaaguacguggucgccgacaagggcaccaaccuguucuucgccaucuacgaggacgaggaggggaagcgguacuacuacuccgugccgcugcgcgaggccaucgagcggcagaagcagaagcucagccccgugcccgaguacaacgagaagggcgucgcccugaaguucuaccugucccccaacgaccucguguacgugccgacggaggaggagcgcaccauggggaccugccacaucgacaagacccggaucuacaagauggucagcuccagcgagaaccgcugcugcuucgugcccuccacgaucgcgaaggucaucgccgacaagguggagcugcugagccacaacaagaucgagaaggccaucaccggcgaguccaucaaggaggugugcuggaagcucaaggucgaccggcuggggaacauccugaacgugaucaaguga

SEQ ID NO: 2247 - RNA, 4464 nt, Artificial Sequence
  Cas9 variant
augaagaacgugcugggccucgaccuggggagcaacuccgucggcugggcccuggugaagaccgaggacaacgggaaccccaucggcagcaucaagauggggucccgcaucaucccgaugagccaggacauccucggcuccuucgagaagggcgacaccgugagccagacggcccagcggacccuguaccgcgggaagcggcgccugaccgagcggcacguccuccgccgggagcgccugugccgggugcugcacaucaugaacuuccuccccgaccacuucgacaagcugcugggcugggacaagaccgacaacaagacguacgggaaguucaucgacgacuccgagcccaagcucgcguggcgccagaacaagaacgagaaggagaagauggaguucguguucauggacagcuuccacgagaugcuguccgacuucgccaagcaccagccccagcugaucgccaacggcaagaaggucccgcucgacuggaccaucuacuaccugcggaagaaggcccugacccagcucaucagcaaggaggagcuggccuggauccugcucaacuucaacaagaagcgcggguacuaccagcugcggggcgaggaggaggaggagcagcccaccaagaaggaggaguacaaggugcugaaggugaucuccgucgacgcggacgagggccagaaggggaacggcaucugguacaacauccaccucgaggacgggggcaucuacaagcgcaagagcgacaucccccuguacgacugggugggcaagacgcugcagcucaucguggucaccaucuacgagaaggacgggaagacccccaagaucuucgacuccggcaagcagaacccgagcuaccggcugcccaaggaggacgacugggggcugaucaagaagcgcaccgagucccagauccagagcuccggcaagacggugggggccuucaucuacgacaacauccucagcaagcccgccgacaagauccggggcaaccuggugcgcaccaucgagcggaaguacuacaagaaggagcugaucgagauccuccagcagcaggccaaguaccacgacgagcugcacaaccagcaccuccuggaguccugcgcgaaggagcuguacgcccacaacgacguccgcuacaacgagguggucaagagcaacaugauccaccuccugguggacgacaucaucuucuaccagcggccccucaagagcaagaagucccugaucgacaacugcaaguacgagagcuacgaguacguggacaaggagaccggcgaggugaaggagaugccgaucaagugcaucgccaaguccaaccccuacuaccaggaguuccgccuguggcaguucauccacaaccugcgccugagcgacgucgugacccgggaggacgugacggcccaguaccucuccacgccccaggacuacugcaaccuguucaccuaccugaacgaccgcaaggagaucaagcaggacauccuccugaaggacuucuuccagaucaagaagguccagaucgacaaggagaagguguuccccaucgaguggaacuacaucaaggacgccaccaagaccuacccgugcaacgagaccaaguacgagcugcugagcgcgcucaagcgggccgggauggacaagcaguggcuggacgacacccccaacaugcaguaccgccuguggcaccuccuguacuccgucgaggagaaggaggagagcgccaaggcccugcggaagcucuacgacgacgacaacuucguguccagcuuccugaagaucaagcccuucgagaagugcuacggcgccuacuccgagaaggcgaucaagcgccugcucacccugaugcggauggggaaggccugggacgagcaggccaucgacgccaagacgcugaagugcauccagcagaucaucaccggcaacaucgacagcaagcucaaggagaagaucgacgacucccgcuacgugcugcaccacgucagcgacuuccaggggcugcccaccuaccucgccuccuacgugaucuacggccggcacagcgaggugaccgacauccgcugcugggacacgccgaaggaccugcugaaguucaucugcggcuucccccagcacucccuccggaaccccaucgucgagcaggucauccuggagacccugcgcgugguguacgacaucuggaaggcggagaagcacaucgacgagauccacguggagguggcccgggagaugaagcucaccgcccagcagcgcaacgaggccaaccugcggaaccugaacaacgaggccaccaaccuccgcaucaaguaccugcuggaggagcucaagaacgacacguucaucaaggacguccggccccugagcccgaugcaccaggagaagaugcgcaucuacgagcaggcggugcuggggaaccucaacaagcaggacaaggacuacgacgacaucaucaagaucuccaagaaggagcggcccaccagcgccgagcugauccgcuacaagcuguggcucgagcagaaguacugcagccccuacaccggcaaggccaucucccugagcaagcuguucaccacggccuaccagaucgagcacgugaucccccagucccgcuacuucgacaacagcuucaacaacaaggucaucugcgaguccgaggugaacaaggagaaggacaagaugcucggguacgaguucaucaagggccgcgggggcgaccggaucuacugcaccgcgcacggcaaggaggugaccauccugaaggaggaggaguacaagcaguucgucaacgagcacuacgcccacaacaagcggaagcgcgacaaccugcucgccgagaacaucccggagagcuucuccagccggcagcugaacgacacccgcuacaucaccaagacgaucaugucccugcucagcaacguggugcggcagcagggggaggaggaggccaccgccaagaaccugcugcccuccagcggcgcggucaccgacaagcucaagaacgacugggggcugaaggacguguggaacaccaucgugacgccccgcuucgagcggcugaacaagcucuccggcaccaacgacuucggcgagaugaaggaggagaacgggaaccgcuacuuccagaccaacgucccgagcgaguacgagaagggcuucaagaagaagcggaucgaccaccgccaccacgccauggacgcccuggugaucgccugcaccacgcggaacauggugaacuacaucuccaacgucaacgccaacagccccaagcagcgcgaggaccugcggcagcuccugugcgacaagaaccgcaucaucaacaagcccuggaacaccuucacccaggacgcgcugaaggcccucaacgacaucgugguguccuucaagaacaacguccggaucaucaaccgcgccaccaaccgguaccagcgcuacgacaagaacgggaagaagaugaucugcagccagaagggcaacgacaugugggccauccgcaagagcaugcacaaggagacgguguucgggcgggugaaccugauccgcaaggaggcccugcccaucgcgaaggcccucgacaacaucuccgccaucugcaacgcccagcugcgggcguacgucaacgaccugguggacaagcacuucaacaagaagcagcucguggcccacuucaagagccuggacuacaaguggaaccgccaggacgucuccaagguggagguguggaucagcuccgacgacaagaccccgauggucgccgugcggaagccccuggacaccagcuucgacaagaagaagaucgccuccaucaccgacacgggcauccaggccauccuccugaacuaccuggagagcaagggcggggacgcgcucguggccuucgcccccgagggcauccaggagaugaacuccaacaucgagcuguacaacaacgggaaggcccacaagcccaucaagaacguccgccugagcgagacccucggcgccaaguaccaggugggggagcggggcgcgaagaccaagaaguacguggucgccgacaagggcaccaaccuguucuucgccaucuacgaggacgaggaggggaagcgcuacuacuacuccgugccgcugcgggaggccaucgagcgccagaagcagaagcucagccccgugcccgaguacaacgagaagggcgucgcccugaaguucuaccugucccccaacgaccucguguacgugccgacggaggaggagcggaccauggggaccugccacaucgacaagacccgcaucuacaagauggucagcuccagcgagaaccggugcugcuucgugcccuccacgaucgcgaaggucaucgccgacaagguggagcugcugagccacaacaagaucgagaaggccaucaccggcgaguccaucaaggaggugugcuggaagcucaaggucgaccgccuggggaacauccugaacgugaucaaguga

SEQ ID NO: 2248 - RNA, 4464 nt, Artificial Sequence
  Cas9 variant
augaagaacauccugggccucgaccuggggagcaacuccgugggcugggcccuggucaagguggaggagaacgggaaccccaucggcagcaucaagauggggucccgcaucaucccgaugagccaggacauccucggcuccuucgagaagggcgacaccgugagccagaccgcccagcggacgcuguaccgcgggaagcggcgccugaucgagcggcacguccuccgccgggagcgccugugccgggugcugcacaucaugaacuuccuccccgcgcacuucgaccgccugcugggcugggacaagaccgacaacaagaccuacgggaaguucaucgacgacuccgagcccaagcucgccuggcggcagaacaagaacgagaugggcaagauggaguucguguucauggacagcuuccacgagaugcuguccgacuucgccaagcaccagccccagcugaucgccaacgggaagaaggucccgcucgacuggaccaucuacuaccugcgcaagaaggcccugacgcagcucaucagcaaggaggagcuggcguggauccugcucaacuucaacaagaagcggggcuacuaccagcugcgcggcgaggaggaggaggagcagcccaccaagaaggaggaguacaaggugcugaaggugaucuccgucgacgccgacgaggggcagaagggcaacgggaucugguacaacauccaccucgaggacggcggcaucuacaagaagaaguccgacaucccccuguacgacuggguggggaagacccugcagcucaucguggucaccacguacgagaaggacggcaagacccccaagaucuucgacagcgggaagcagaacccgagcuaccggcugcccaaggaggacgacuggggccuggugaagaagcgcaccgagucccagcuccagagcuccgggaagaccgugggcgccuucaucuacgacaacauccugagcaagcccgacgacaagauccggggcaaccugguccgcacgaucgagcggaaguacuacaagaaggagcucaucgagauccugcagcagcaggccaaguaccacgacgagcugcacaaccagaaccuccuggaguccugcgcgaaggagcuguacgcccacaacgacgugcacuacaacgaggugaucaagagcaacaugaucaaccuccuggucaacgacaucaucuucuaccagcgcccccucaagagcaagaagucccucaucgccaacugcaaguacgagagcuacgaguacguggacaaggagaccggggagaucaaggagaugccgaucaagugcaucgccaaguccaaccccuacuaccaggaguuccggcuguggcaguucauccacaaccugcgccucagcgacguggucacccgcgaggacgugaccgcccaguaccuguccacgccccaggacuacugcaaccuguucaccuaccucaacgaccggaaggagaucaagcaggacauccugcugaaggacuucuucaagaucaagaaggugcagaucgacaaggagaaggucuuccccaucgaguggaacuacaucaaggacgcgaccaagagcuacccgugcaacgagacccgcuacgagcugcucuccgcccugaagcgggccggcauggacaagcaguggcuggacgacacgcccaacaugcaguaccgccucuggcaccuccuguacagcguggaggagaaggaggaguccgccaaggcccugcggaagcuguacgacgacgacaaguucgucaccagcuuccugaagaucaagcccuucaacaagugcuacggggcguacuccgagaaggccaucaagcgccuccugacccugaugcggaugggcaaggccuggaacgagcaggccaucgacgccaagacccucaagugcauccagcagaucaucacggacaacguggacagcaagcugaaggagaagaucgacgacucccgcuacgugcugcaccacgucagcgacuuccaggggcuccccaccuaccuggcguccuacgugaucuacggccggcacagcgaggugaccgacauccagugcugggacuccccggaggaccugcucaaguucauccgcgacuucaagcagcacagccugcggaaccccaucgucgagcaggucauccuggagacccuccgcgugguguacgacaucuggaaggccgagaagcacaucgacgagauccacguggagguggcccgggagaugaagcugacggcccagcagcgcaacgaggccaaccugcggaaccucaacaacgaggcgaccaaccugcgcaucaaguaccugcucgaggagcugaagaacgacaccuucaucaaggacguccggccccugucccccauccaccaggagaagaugcgcaucuacgagcaggccgugcucggcaaccugaacaagcaggacaaggacuacgacgacaucaucaagaucagcaagaaggagcacccgaccaacgccgagcugauccgguacaagcucuggcuggagcagcgcuacugcagccccuacacggggaaggccaucucccugagcaagcuguucaccaccgcguacgagaucgagcacaucaucccccagucccgcuacuucgacaacagcuucaacaacaaggugaucugcgaggccgaggucaacaaggccaagggcaacaugcugggguacgaguucaucaagaagcagggcgggcagaagaucuacugcacccagcugggcaaggccgugacgauccucaaggaggaggccuacaagcaguucgugaacgagcacuacgcgcacaacaagcggaagcgcgacaaccugcuggccgagaacauccccgaguccuucagcucccggcagcucaacgacacccgcuacaucaccaagaccaucaugagccugcuguccaacgucgugcggcagcagagcgaggaggaggccaccgccaagaaccuccugccguccagcggcuccgugacggaccgccugaagaacgacugggggcucaaggacgucuggaacaccaucgugacgccccgguucgagcgccugaacaagcugagcggcaccaacgacuucggggagaugaaggaggagaacggcaaccgguacuuccagaccaacgugccccucgaguacgagaagggcuucaagaagaagcgcaucgaccaccggcaccacgccauggacgcgcuggucaucgccugcaccacccgcaacauggugaacuacaucuccaacgccaacgccaacagcccgaagcagcgggaggaccugcgccagcuccugugcgacaagaaccggaucaucaacaagcccugggacaccuucacgcaggacgcccugaaggcgcucaacgacaucguggucuccuucaagaacaacgugcgcaucaucaaccgggccaccaaccgcuaccagcgguacgacaagaacgggaagaagaucaucuucagccagaagggcgacgacaugugggccauccgcaagagcaugcacaaggagaccguguucgggcgggucaaccugauccgcaaggaggugcugcccaucgccaaggcgcucgacaacaucuccgccaucugcaacgcccagcugcgcgccuacgugaacgaccuggucgacaagcacuucaacaagaagcagcucguggcccacuucaagagccugaacuacaaguggaaccggcaggacguguccaaggucgagguguggaucagcuccgacaacaagacccccaugguggcgguccgcaagccgcuggacacgagcuucgacaagaagaagaucgccuccaucaccgacaccggcauccagaccauccuccugaacuaccuggagagcaagggcggggacgccuccguggccuucgcccccgagggcauccaggagaugaacagcaacaucgagcucuacaacaacgggaaggcgcacaagcccaucaagaacgugcggcuguccgagccccugggcgccaaguaccaggucggggagcgcggcgccaagacgaagaaguacguggaggccgacaaggggaccaaccucuucuucgccaucuacgaggacgaggagggcaagcgguacuacuacagcgugccgcugcgcgaggcgaucgagcggcagaagcagaagcugucccccguccccgaguacaacgagaagggcguggcccucaaguucuaccugagccccaacgaccugguguacgucccgaccgaggaggagcgcaccauggggacgugccacaucgacaaggcccggaucuacaagaugguguccagcaccggcugcuccugcuacuucgugcccagcaccuucgccaaggucaucguggacaaggucgagcuccagucccugaacaagauggagaaggcgaucaccgacgagugcaucaaggaggugugcuggaagcugaagguggaccgccucgggaacaucaucaacgucaucaaguga

SEQ ID NO: 2249 - RNA, 4485 nt, Artificial Sequence
  Cas9 variant
augaagaacauccugggccucgaccuggggaccaacagcaucggcugggcccugaucgacaacgagagccaccgcaucaucaagagcgggucccggaucauccccauggacgccgcgaccaugggcgacuacgagaaggggaaccucaagagcgccgacuggaagcgcacguccuuccggggcaugcgccggcuguacgagcgcgccaagcugcggcgcgagcggcuccugcgcgugcugaacauccucggcuuccugccggaggaguuccggcgccagaucgacuucgagcaccaccccgggcaguucaucgacggcaaggagccccugaucgccuaccaccacgacgagaacgggcagcgggucuucagcuacauguccgccuucgaggagaugcucaccgacuuccgcgcgacccagagcgagcuggugcgggacggccgccgggugcccuacgacuggaccaucuacuaccugcgccacaaggcccucacgcagccggucaccaaggaggagcuggccuggaucauccugaacuucaacaccaagcggggguacuaccagcuccgcuccgagagcgaggaggugaccacgaacaagaacgaggaguacgccgagcugaagguggucuccguggagaagaccggcgaggacaagaagcgggcgggcuacuacugguacaccaucaccuacgacaacgaggccgagcagaagaucacgagcaccaucccgccccgccagaucggggacaagguggagcugaucgucaccaccgcccgcgacaaggccggcgagaucaagaaguccgugcggagccccaaggaggacgacuggacgcucaugaagaagcgcaccgagcacaacaucgaggaggaggagugcaccgugggguccuacaucuaccagcacauccuggccgaccccaccgucaaggugcggggcaagcuggugcacacgaucgagcgcaaguucuacaagaaggagcucaagcagauccugaacaagcagaaggaguucauccccgagcugcaggacgcgagccucuacgaggccugcaucaaggagcuguaccggaacaacgaggcccacauccaguccaucgccaacaaggacuucaccgaccuguucgucaacgacaucaucuucuaccagcgcccccucaagagcaagaaguccaccaucagcaacugccccuacgagagcuacuacuacaagaacaaggagaccggcgagcugauccggaagccgaucaagugcaucgccaaguccaacccccuguaccaggaguuccgccucuggcaguucgugcacaaccugcggaucuacaagaaguccgaggaggugagcgggcgccugcagacggacgucgacgugaccgaccgguuccucaccacccccgacgacuacgcgaagcuguucagcuggcugaacgaccgcaaggagaucaagcagaaggagcuccugcgguacgaggccuucggccuguccaagagcuacggggacuaccgcuggaacuucguggaggacaagcccuacccgugcaacgagacgcuccacgagaucaaccggcgcaugaaguccauccugagcgacaagaagcuguccagcgaggccuaccagcagcucuggcacauccuguacuccaucgacgaccccaucgagauccggaaggcccugaccagcuucgcccagaaccaggagaucaacuccgacgacuucgucaacgcguucuaccaguacgugcccgagaagaccaagagcuacggcgccuacuccgagaaggccaucaagaagcuccugccccugaugcgccgggggagcuacugggccaucggcaacaucgacgagaagacccaccgccgccuggacaacaucaucaacggcguggccgacgacuccaucagcacgugcacccgggagaagcucaacaaccugaccgacaucaccaugugccaggggaugccgcuguggcaggcgugcuacgccgucuacgaccgccacuccgaggccgccgacacgaccaagugggagcagcccgacgacaucgacaccuaccucagcaccgagcugaagcagcacagccugcggaaccccaucguggagaccgucaucuccgagacgcuccgcguggugcgggacaucuggaaggcguacggccgccccgaggagauccacgucgagcuggggcggaaccugaagcaggacgccaagagccgcaagcaggacgccauccggauggccgagaacgagcagaccaaccuccgcauccgggcccugcugcaggagcucuccaacccggagugcggcguggagaacgugcgcccccacagccccucccagauggagcugcugaagaucuacgagaacgagguccuccagagcaccgacgacauccccgaggagaucuccaacaucaucaaggaccuggggaagaccgacagcaagaagcggccgucccugagcgacaucacgaaguaccgccucuggcuggagcagaaguaccagucccccuacaccggccacaucaucccccugagcaagcuguucaccccggcguaccagaucgagcacgugaucccccagucccgguacuucgacgacagcaucuccaacaaggugaucugcgaggccgaggucaacaaggagaaggaccgcaugcugggcuacgaguucaucaucaacaagggcgggagcaucgugaagggguccuucggccagcaguucaagaucuucgacaaggugcaguacgaggacuucgucaagcagcgguacgcccacaacaagaccaagaugaagaagcugcucauggacgacauccccgacggguucauccagcgccagcugaacgacagccgguacaugagcaagaagaucaucuccauccugagcaacaucgugcgcgaggacggcgagaaggaggccacguccaagcacaucaucgugaccagcggcgccaucaccgaccggcucaagaaggagugggggaucaaggacgucuggaacgacaucaucgcgccccgcuucaagcgccugaacaagcugaccgacuccaacaacuacggcauggagacggagaaggaggggcggcaguacuuccagaucaacgugccgaccgagcucagcaccggccugaucaagaagcgcaucgaccaccggcaccacgccauggacgccaucaucaucgccugcaccacgcgcaaccacgugaacuuccugaacaacuccaccgccgcgagcgaccagaaggacauccggcgcgaccuccagcacacccugugcaccaagacgaagaccgacuccaacggcaacuacgucuggcgguucaacaagcccugggacaccuucacccaggacacgcgccaggagcuggaggggaucaucgugagcuucaagcagaaccuccggaucaucaacaagauguccaacuacuaccagcacuacguggacggccgcaagaccaucagccggcagaacaagggggacggcugggccauccgcaagucccugcacaaggccaccgucagcgggaaggugaaccugaagcgguccaagaccgugggcuucaaggaggcccucaacgacuggagcgcgaucaaggacaagacguccaaggccauccugcagaagaucaucgcccaguacaagaacuacgaccccaagaccaucuucaaguacuucaaggaccgcaacuucaaggucgagggcaaggacuucagcaagcuggagguguacuacaacaccuccgacaaggagcccaugagcgcccaccgggugaacaucgacaccacguucgacgagaaggagauccgcagcaucaccgacaccgggauccagaagaucaugcucaagcaccuccacaccuacgacgacgcccagggcaagacgcacccggaggcggccuucucccccgaggggaucgagaagaugaaccagaacauccggaugcugaacggcgggaaggaccacaagcccaucuucaagguccgcaaggccgagauccucggcaugaaguucgccgugggcgagcgggggcacaaggacaagaaguggguggaggccgacaagggcaccaaccuguucuucgcgaucuacgagagcgaggagaacaagcgcuccuacagcuccaucccccugaacgaggccaucgaccgccucaagcgcggggagaacaucgccgacgagcgggaccagaacggcaacaagcugcuguucguccucagcccgauggaccugguguacgugcccgaccccgacgacgcccacaucgacgaggucaaggggaacaacaacaucuucaagaugguguccugcaccggcaccgagugcuacuucgugcccgagaccuacgccaacgucaucugcaagggcaaggagcuggagagcaagaacaagguggaguccuacgacgggaucaacaucaagaaguccugcuacaagaucacgguggaccggcucggcaagguccgcaagaucuucaagggguga

SEQ ID NO: 2250 - RNA, 4491 nt, Artificial Sequence
  Cas9 variant
augaagaccauccugggccucgaccuggggaccaacagcaucggcugggccaaggugugcgucgacgacaacgggaacuaccugcgcgacaucaagcucggcucccggaucauccccaugagccaggacgugcuggggaacuucgacaagggcgugacggagucccagaccagcguccgcaccggcuuccgcggggugcggcggauccgcgagcggucccugcuccgccgggagcgccugcaccgggugcugcacguccucggcuaccugccgccccacuacgacagcgccaucggguggaacaagaacgagcccuccaccuacggcaaguuccugaaccacggggagcccaagcucgcgugggagcacaaggaggacggcagcaugcgcuuccuguucauggaguccuuccacgagaugauggccgacuucgccaagagccagccgucccuggugagcgacggcaagaagaucccccucgacuggacgaucuacuaccugcggaagaaggcccugucccagcccauccgcaaggaggagcucgccuggcugcugcucaacuucaaccagaagcggggguacuaccagcugcgcggcgaggaggacgacgacaaccccaccaagugcgaggaguacuacgagcugaagguggucgggaucgaggcggacgaggagggcaagaacggcaacaccugguacaacgugaagcucgagaacggguggaucuaccggcgccagagcaagaucccgcuggacgacuggaucggcaaggugcgggaguucaucgucaccacggaguacgagaaggacgggaucacccugaagaaggacaagaacggcgacgugaagcgcuccuuccggagccccuccgaggacgacugggggcuccgcaagaagcgcaccgagaagcugcuggacagcuccaagaugaccgugggcgccuucgucuacgaccaccuccuggccgagcccagcgacaagauccggggcaaguucauccgcacgaucgagcggaaguacuacaagaaggagcuguacgccauccucugcgagcagagcaaguaccacgaggagcugcgcuccggggacuaccugaacaagugcgcggaggagcucuacaagaacaaccagccccaccggaacagccugcugaccaaggaccucgccuaccugcugcucgaggaccugaucuucuaccagcgcccgcugaagaccaagaagucccucaucgccgagugccccuacgaggccuacaaguacguggacaaggagaccggcgagaucaagcggcaggggaucaagugcaucgccaagagcaaccccuacuaccaggaguuccgccuguggcaguucaucuccaaccugcgccucuucaacaaggcggacgacaaggaggugacggccgacuaccugcccacccaggacgacuacguccggcuguucgccuaccugaacgaccggaaggagaucaaccaggagacccuccugaaggaguucuucaagcugaagaagaucaccgugaacagcgagaagguguucccgauccgcuggaacuacaucgaggacaaggagaagaaguaccccugcaacgagacgcggcacgagcuccugcuggcccucgaccgcgcccggaucgaccacuccuggcuggagaagcccggccaggaguaccgccuguggcaccuccuguacagcgucgaguccaaggaggagaccaaggaggcgcugcggaagcucaaggacgacgacgccuucguggagagcuuccugaaggugaagcccuucaagcgcgaguacggggccuacuccgagaaggccaucaagaagcugcucgccgucaugcggaugggcagccuguggcgcgagaccgacaucugcgacaccacgaagggcaacaucaccaagauccugcagggggagaucgacgagaagcucaaggagaagaucuccgcgagcguguccagcuacaaccagcuguccgacuuccagggccugccggucuggcucgccugcuacgugguguacgggcgccacagcgaggccgccgagauccagcacuggaagacccccgagucccugcuggccuacaucaacggcuucaagcagcacagccuccggaaccccaucgucgagcagugcauccuggagacccugcgcacggugcacgacaucuggaaggagguggggcacaucgacgagauccacgucgagcucggccggaacaugaaguccaccgcggaccagcgcgcccggaucagcgagaacgugcugcgcaacgagaacaccaaccugcggaucaagagccuccugcuggagcucaagaacgaccccaacaucaaggacgugcgcccguacucccccaugcagcaggagaagcugcggaucuacgaggagggcguccugcaggagcucaccaaggacgacaaggacuucacggagaucaccaagaucagcaccauggcccagcccuccgccaaggagcugcagcgcuacaagcuguggcucgagcagaaguaccggagccccuacaccgggaaguccaucagccugacgaagcuguucaccuccgcguaccagaucgagcacgugaucccgcagagccgcuacuucgacgacuccuucagcaacaaggugaucugcgaguccgaggucaacagccucaaggacaacaugcugggcuacgaguucaucaagaaccacgggggcgagaucauccacugcaccaugcugggcgacgugaaggugcucuccgagagcgaguacaaggccuucgucaacgaccacuacgcccacaacaagcggaagcgcgagaaccugcugcucgaggacaucccccaggaguuccugaaccggcagaugaacgacucccgcuacaucagcaagguggugaaggcccugcucagcaacaucguccgggccgagggggaggaggaggcgaccuccaaguucguggugagcugcuccggcgggaucaccgaccgccugaagaaggacuggggccugaacgacgucuggaacaagaucguguacccccgguucgagcgccucaaccggcugacggggaccgaggccuucggccagugggagaacaaggacggcaagcgcguguuccagaccgccgucccgcuggagcuccagcgcggguucaacaagaagcggaucgaccaccgccaccacgccauggacgcccuggugaucgcgugcaccagccggaacaucaucaacuaccugaacaacgaguccgccaacaaccccaagaagcgcgaggaccuccggcagaagcugugcgacaagaaccgcacgauccggaagcccugggagaccuucacccaggacgccaccgccgcccuggaggacgugaucgucagcuucaagaacuacgugcgcaucaucaacaaggcgacgaacuacuacgagcgguacgacguggagggcaagaaggucaucgccgagcagcgcggggacgacaugugggccauccggaagcccaugcacgaggccaccuacuacggccgcgugaaccuccggcgcaagaagaaggugaaccugcgggucgcgcuggagaacaucuccagcaucugcgacaacaagcuccgcaucuacaucaacgggcugguggagaagggcuucaacaccaagcagauccuggacaaguucaagaacaccaacgaccacuucuccaugcagaagaucgacaagguggagaucuggcaguucacgaacgaggaggagaagcucgucgccacccggaagccgcuggacaccagcuucgacaccaagaagaucgccuccaucacggacaccggcauccagaccauccugcucaacuaccuggagaccaagggcggggacagcacgaucgccuucacccccgaggggaucguggagaugaaccagaacaucuccaaguacaacaacggcaaggagcacaugcccauccugaaggugcgccucuacaccaagcuggggaagaagauccccgucggccagaccggcugcaaggccaagcaguucgugaucgcggaggccgggacgaaccuguacuucgccaucuacgaggacgaggagggcaagcggagcuaccgcaccaucccgcucaacgagguggucgagcgccugaagcaggggcugucccccgugcccgagaagaacgacaaggacgugcaccucaaguucuaccugagccccaacgaccuggucuacgugccgaucgaggacgagcacgagucccucgccaaggaccacaucuacaaguucguggacagcuccggcaccaccgccaacuucaucccccaccggagcgcgaacgucaucuucgagcugaacaagaaggacgccgagaaguucugcagcggguccaucauccagaacgaguacggcgugggcagcucccagagcaagaaccagaaggccaucacgggggagaugaucaaggccgugugccgcaagcuggaggucgaccggcucggcaacgugaucaaggucaucuga

SEQ ID NO: 2251 - RNA, 4497 nt, Artificial Sequence
  Cas9 variant
augaagcacauccugggccucgaccuggggaccaacagcaucggcugggccgugauccgcgcccaccaggacgcggacgggcacaccacgcugcaggacauccucgccgccggcucccggaucauccccauggacgccgccacccugaccgacuucgacaaggggaacgcgcgcagcggcaccgccgagcggacguccuuccgcagcaugcggcgccggcgcgagcggcagcugcuccgccgggagcgccugcaccggguccugaugcuccugggcuuccugccgcagcacuacgccaacucccucacccgcuacggggaguucgccgacaaccgggagugcaagcugcccugggugaaggacgagagcgacggcaaguaccacuuccuguuccaggacgcguuccacgagaugugcgaggacuuccgccagcucgcgccccaguggguggccgacgggaagaagguccccuacgacuggacccuguacuaccugcggugcaaggcccucucccgcaagaucagcaaggaggagcuggccuggauccugcucuccuucaaccagaagcggggcuacuaccaggcccgcgacgaggaggacgaggugaccacgaacaagcuggaggaguacuacgccgggaaggugguccggguggacgacaccggcgagcgcaagggcaagaacguguacuacgacaucacccuggagaacgggugggucuaccgcuacgccgcccggaucuacccggacugggugggccaggugaaggaguucaucgucaccacgacccucaaccccgacgggacccccaagaccgacaaggccggcgaggugaagcgcagcuuccggaugcccaaggacgacgacuggacgcugaucaagaagaagaaggagcgcgacaucgaccggucccaggagaccaucggccaguacaucuaccacgcgcugcucaaggacccgagccagaagauccgcgggaagcugaucggcaccguggagcggaaguacuacaaggacgagcugcgccggauccucgaccgccagauccaguuccaccccgagcugcgggaccgcgagcuguacuacgccugccuccaggagcuguaccccuccaacgucgccuuccggaacacccuggugaaccgcgacuucacguaccucuuccuggacgacauccuguucuaccagcggccccucaagagcaagaagucccagaucagcgacugcccguacgaggagcacuucuacaccgacaaggagaccggggagcgcaucuccgugcccgucaagugcaucgccgugagccacccccuguaccaggaguaccggcuguggcaguucauccagaaccuccgcaucuacugccgggaggcccgcaucgacggcaaccugaugaucgacugggaggugaccaacgagcugcuccagacggaggaggacaagaccgcgcuguucgacuggcugaacgacaaggaguccgucaagcagcccgagcucguggccuuccugcucgggggcaaggccaacaagaagcagaucaaggccuaccgcuggaacuacauggacgacgacaccaagggcuacccgugcaacgagacccgggccagccugcucaaguaccugcgcgaggcgcagacggacagcuccuuccugacccgggagcgcgaggaggcccucuggcacauccuguacagcaucuccgacaagggggagcucaagagcgcccugggcaaguucgccgugaagcacgggcugaacgagcgguucgucaccguguucuccaaguucccgcccuucaagaaggacuacggcagcuacuccgcgaaggcccugaagaagcuccugccccugaugcgcauggggcaccacuggcaggaggccagcuucauccccuccacccggcagcgcauggagaaguucaucaacggcgaguacgacgacagcaucgacaagcggacguacgagaagcucgagucccugaccgaggucagccaguaccgcggccugcccggguggcucgccugcuacgugguguacgaccggcacuccgagggccgcgacaucgagcgguggaccagccccuccgacaucgacagcuaccuggcccaguucaagcagcacucccugcacaaccccaucgucgagcgcguggugcucgagacccugcggacgguccgcgacaucuggaagcaggucgaccacaucgacgagauccacaucgagcuggggcggaacaugaagcucccggcggacaagcgccggcagaugaccgagcaggccuggaagaacgagcagaccaaccugcgcaucaaggcccugcuccuggaguucgcccggcccggcuacgacaucgagaacgugcgccccuacagccccuaccagcaggaccagcugcgcaucuacgaggaggccgugcucggggcgaacgagugcccggacgacaucuccgccauccugaagaaguucaacggccugaacccgcccaccagcgccgaggugcuccgguacaagugcuggcuggagcagaaguaccgcagccccuacaccggccggacgaucccccuguccaagcuguucaccagcgccuacgagaucgagcacaucauccccaagcagcgcuacuucgacgacuccuucagcaacaaggugaucugcgaguccgaggucaacaagaagaagggggccaugcugggcuacgaguucaucaagagcuaccacggggcguccaucacccugaaccggggcggcaccgccagcaucuucuccguggaggccuacgagaacuucgugaaggagcacuacgcccacaaccgcgggaagaugaagaagcuccugauggacgacguccccgacagcuucaucucccggcagcugaacgacagccgcuacaucuccaagcucaugaaguccauccugagcaaccuggugcgggaggagggcgagaaggaggcgaucagcaagaaccucaucgugugcaccgggggcaucaccgaccgccugaagaaggacugggggauccacgacgucuggaacgacaucaucuucccgcgguucaagcgccuggacgagauggacuccagccacaccuacaucacccucaacacgcaccggcaccccauccccagcaugccccuggaguuccagcgcggcuucuccaagaagcggaucgaccaccgccaccacgccauggacgccaucgugaucgccugcgccacccggaacaucgugaacuaccugaacaacgagagcgcgcgccacgacgccaagaccucccggauggaccuccagcgccugcugugcaccgccaaccgcaagcucaucgacaagccguggaagacguucacccaggacacgugcaagguccuggaggacaugaucgugagcuuccagcggacccugcgcaucaucaacaagacgaagaacuacuaccuccgguucgaggacggcaagaagcgccgggugcugcagaccaagggggacaacugggccauccgcaagccccugcacaaggagaccuucuacggcgagaucaaccuccggcgcaucgagacccugucccugaacaaggcccucgagcggauccccgacaucgucgagcgcgaccugcggaagaagcugagcgagcuccugucccugggguacaacgcgaagcgcaucaagggcuacuucgaggagcacaaggaggaguggagcgacgugaaccucuccaagaucaaggccuacuacuucacgaagcagaagaacaagcgguacuucgccgcccgcaccgagcuggacaccagcuucaacaaggacaagaucgagaacaagaucgccgacaccgcgauccagaagauccugcuccagcaccuggaggccuacgggaacgacguggagcaggccuucucccccgagggcaucgacacgaugaaccggaacauccgccagcugaacggcgggcggagccaccagccgaucuacaagguccgcguguacgaggaggccaccaaguucgcggugggccggcgcgggaacaaguccaccaaguucgucgaggccgccaagggcaccaaccucuucuucgccaucuacgagaucagccagguggacgggaacggcaaccggcagacgucccgcaccuucagcuccaucccccugaacguggccgucgagcgccugaagcagggccucccgcccgugcccgaggacgaggaggggaacgcgcccaaguacgugcugagccccaacgaccuggucuaccuccccaccgagaaggagcugaagcggcgcgagaucgccaugccgaucgacaagucccggaucuacaagauggugagcugcaccggcaaggacugcuucuucauccccgccaacacggccgugcccaucgucgaccgcuacgaguacagcuccaugaacaagaucgggcgggcccugaccggcgagaugaucaaggagaucugccucccccugaagaucgaccgccuggggcagaucaucgagaucagcaccuucuga

SEQ ID NO: 2252 - RNA, 4506 nt, Artificial Sequence
  Cas9 variant
augaagaagauccugggccucgaccuggggaccaacagcaucggcugggccgugaucaacaaggccgagaacgaggggaaggacguccugugcggcaucgaggcggccgggucccgcaucauccccauggacgccaccaucaugggcgacuucgagaagggcaacagcgugucccagacgaaggaccggcgcgagcaccggagcacccgccggcucuacgagcgcgggaagcugcggcgcgagcggcugaaccgcgugcucuccgucaugggcuuccugccggaccacuacgugagccagcuggaccgguacgggaaguuccucuccaacaccgagcccaagcuggccugggugcgcaacgccgacugcaaguaccacuuccuguucauggacagcuucuccgagaugcuccaggaguucaagaccaacagcccccaguacaucuccgaggagagcaagguccccuacgacuggacgcuguacuaccugcggaagaaggcgcucacccacaaggugaccaaggaggagcuggccuggauccugcucaacuucaaccagaagcgcggcuacuuccagcugcgggacgaguccgaggaggagaagaagccgagcaagauccgccaguacuucgagcaccagaagguggucgacaucaucgacaccaacgagguguacaaggggcugaaggugcucaucgucauccuggccaacggcaucuccggcaagaucuucaagaaggagauccccgacuggaucgggguggagaaggacaucaucgugaaggucgacaucgacaaggacggcaaggacaaguucaacgaggacgggagccuguccugccgguucaacauccccacggaggccgagugggacaccgagugggagcucaucaagcagaagacccagaacgaccuggacgcgagcggcaagaccgugggcgaguacaucuucgacacgcugcuccgcaaccccgagcagaagauccgggggaagcuggugcgcaccaucgagcggcgcuacuacaaggaggagaucaacgccauccugaagaagcagaaggaguuccacccggagcucuccgaccgcgcccuguacgagaagugcgucgaggagcuguaccccaacaaccccgcccaccggaacaugaugcucauccacgaccugagcuacuuccuggugaacgacauccucuucuaccagcgcccccucaagagcaagaagucccugaucgacgagugcccguacgagagccaccucuacaucgacaagaaguccggcgagcggaagcccguggccgucaagugcaucgccaagagccacccccuguaccaggaguuccgccuguggcaguucaucuccaaccuccggaucuaccagaagaccaaggagguggggaacagccugaagguggacgucgacgugaccaacgaguuccugaagggcgagaacgacuacgucgagcuguucgacuggcugaacacgaagaaggagaucaagcaggaggacuuccugaaguacaagcccuucggguucaccaagggcaacaucaacaacuaccgcuggaacuacguggaggacaagaucuacccgugcaacaagacccacuacaccauccucaagggccuggagaaggcggacaucacguucgacgaguucaucucccacgacagccuggccgaggagaaccuguggcacauccucuacuccgugagcuccaaggaggagcugaagcacgcccuggagagcuucgccgacaagcgggggcucuccaucaaguucgucgacgcguucaucaacacccccgccuucgagaaguccuacggcgccuacagcgccaaggccaucaagaagcugcugccccucaugcgcauggggaaguacuggaaggaggagaacaucugcgacagcacccgggagcgcaucgacaagaucaucaccggcgaguacgacgagaacauccgggaccgcgugcgggagaaguccaucaaccugacggacaucacccuguuccgcgggcucccccuguggcuggcgugcuacguggucuacgaccggcacagcgaggccggcaacaccgagcgcuggaccuccccgagcgacaucgaccacuacauccggaaguucaagcagcacagccuccgcaaccccaucguggagcagaucgugcuggagacgcugcggaccguccgcgacguguggaccgaggugggcgggaucgacgagauccacgucgagcucggccgcgagaugaagaaccccuccgacaagcggcgcaagaugagccugcagaugcaggagaacgagaacaccaaccugcggaucaaggcccuccuggccgaguucaucaaccccgagcuggggaucgagaacgugcgcccguacucccccagccagcaggaccuccugcggcuguacgaggagggcgccuggaacucccccgagaucgacgagaagcaggucgacgagaugcucgcgauccugaagaaguucaacgagacggacagcuccaagcgccccaccaagagcgagaucaagcgguaccgccuguggcucgagcagaaguaccgguccccguacaccgggacccccaucccccugagcaagcuguucacgaccgccuacgagaucgagcacgugaucccgcgcucccgguucuucgacgacagccucaccaacaaggugaucugcgaguccgaggugaacaagcugaagggcaacaugcugggcuacgaguucaucaagagccacuacggggagaagguccagcucuccagcggcuccgaggugcagaucuucagcgugaacgacuacgagaaguucgucaaggaccacuacagcaagaacaaggccaagaugaagaagcugcugauggacgacauccccgagaaguucaccgagcgccagaugaacgacucccgguacaucagccgccucaucgugucccugcugagcaacaucgugcgggagaagggggagcaggaguccaucagcaagaacguccucgugugcaccggcggcgugacggaccgccugaagaacgacuggggcgucaacgacguguggaacaagaucauccugccccgguucaagcgcaugaacgagaucaccgacuccaccgacuacaccagcgugaacacguccgggcacaucauccccgccaugccgcuccaccuccagaagggguucaacaagaagcggaucgaccaccgccaccacgcgauggacgccaucgucaucgccugcgccggccggaacaucgugaacuaccugaacaaccagagcuccaagagcgacgugucccgccacgaccugcgcaaccugcugugcgagaaggacaagagcgaccggaaggagcucaucaucaagcccugggacaccuucacccaggacgucuacuccgugcugagcuccaucaucgugagcaucaagcagaaccugcgcgucaucaacaagaccaagaacaucuaccagcggaaggaggacgggaaggugaucaucuccaagcaggagaacaacaucaacuggugggccauccgcaagccccuccacaaggagacggugagcggcgaggucaaccugcggaaggagaccaccaucagccugaaggaggcgaucgacaaccccgcccgcaucaucgacaaggacuucaagaagaagcuccgggagcugauccugaugggcuacaacgagaagcucaucaagaaguacuucuacgacaacaacgaguccuggcaggacgugaaccugaagaagaucccggccuacuacuucaccaaggacacgaacgaccgcuacuucgccagccggucccugcucgacgagaacuucgacaagaagaagaucgagaacaaggugaccgacaccgggauccgcaccauccugcugcggcaccucgaggucgagggcggggacagcaagguggccuucucccccgagggccuggagcgcaugaacaagaacaucgagauccugaacgggggcaagaagcacaagcccaucuacaaggugcgggaguacgagaaggcggagaaguucgccgucggcaugcgcgggaacaaggccagcaaguucguggaggccgccaagggcacgaaccucuucuucgcgguguacgacaacgggaagaagcgguccuucgccaccgucccccugaacgaggugauccgccugcagaaggagggccucccgagcgcccccgccaacgaggaggggcugcugcccaaguucgugcucucccccaacgaccuggucuacgugccgaccgaggacgagcugcggagcggccuccugcccgagaaccccgcgcccgagcgcaucuacaagauggucuccugcaccggcuaccagugcuucuucauccacuucagcguguccggggugcugugcgacaagaaggaguucagcucccucaacaagauggagcgggccaucagcggcgagaugaucaaggagaucugcaucccgcugaaggucaaccgccuggggaagaucauguacaaccucuga

SEQ ID NO: 2253 - RNA, 4506 nt, Artificial Sequence
  Cas9 variant
augaagaccauccugggccucgaccuggggaccaacagcaucggcugggccaagaucuccaucgacgacaacgggaacuaccugcgcgacauccagcucggcagccggaucauccccaugucccaggacgugcuggggaaguucgacaacggcgucacggagagccagaccgccgugcgcaccggcuuccgggggcugcgccggauccgcgagcggucccuccugcgccgggagcgccugcaccgggugcuccacgucaugggcuuccugccgccccacuacgacagcgcgaucggguggaacaaggaggagcccuccaccuacggcaaguuccugaaccacggggagcccaagcucgccugggagcgccagggcgacggcagcaugcgguuccuguucauggacuccuuccacaagaugauggaggacuucgccccgcaccagcccgcccugguggccgacgggcgcaagaucccccucgacuggacgcuguacuaccugcggaagaaggcgcucacccagcccaucaagaaggaggagcuggccuggauccugcucaacuucaaccagaagcgcggcuacuaccagcugcgcggggaggaggaggaggagaacccgaccaagcgggaggaguaccacgagcugaagguggucagcguggaggccgccgaggagggcaagggcgggaacaccugguacaacgugaagcucgagaacggcuggaucuaccaccggcccuccaagaucgaccugagcgacugggucgggaagacgaagcaguucaucgugaccauggaguacgaggcggacggcaucacccugaagaagaacaaggagggggaggugaagcgcuccuuccggguccccgacgaggacgacuggggccuccgcaagaagcgcaccgagagccagcuggaggccuccggcaagacggugggggccuucaucuacgaccaccuccuggccgagcccgccgacaagauccggggcaacuucauccgcaccaucgagcggaaguacuacaagcaggagcuggcggacauccugcgcgagcagagcaaguaccacgaggagcuccaguccaagaagauccuggccgacugcgccgaggagcuguaccggagcaaccagccgcaccgcgacucccuccugaagaaggacaugguguaccugcuccugaccgaccugaucuucuaccagcggccccucaagagcaagaagucccugaucgccaacugccccuacgaguacuacgaguacgucgacaaggagaccggggagaucaagcgccagggcaucaagugcguggccaagagcaaccccuacuaccaggaguuccggcuguggcaguucgugcucaaccugcgccuguacgaccggacggaggacaaggaggucaccgcggaguaccucccgagcaaggaggacuacgcccgccuguucguguaccugaacgaccggaaggagaucaaccaggagacccugcucaaggacuucuucaagcugaagaaggugaagcagcgcuccgagaaggaguuccccguccgguggaacuacaucgaggacaaggagaagaaguaccccugcaacgagacccgccacgagcugcucauggcccuggaccgggccgggauggagcgcagcuggcuggacgacacggcccggcaguaccgccucuggcaccuccuguacuccaucgaggugaaggacgaggcggagcgcgcccugcggaagcugaaggacgacgacgaguucgugagcgccuuccugaaggucaagcccuucaagaaggacuacggcgccuacuccgagaaggccgugaagaagcuccuggcggucaugcgcaugggcagccacuggugcgaggacgacaucugcaaggagaccaaggagcggaucgagcacauccugcagggggacguggaggagaagaucaaggagcgcaugaaccacaccgccuacucccucggcgagcugagcgacuuccaggggcugccggaguggcucgccugcuacguggucuacggccggcacuccgaggccaccgacaucaagcacuggaagacgcccgagagccugauggcguacaucaacggguucaagcagcacucccugcgcaaccccaucguggagcagugcauccucgagacccugcggaccgugcacgacaucuggaaggaggccggccacaucgacgagauccacgucgagcugggccgcagcaugaaguccaccagcgaccagcgggcccgcaugacggagaacauccuccggaacgagaacaccaaccugcgcaucaagucccugcucauggagcugaagaacgacgccgacaucaaggacgugcggcccuacagcccgaugcagcaggagauccugcgcaucuacgaggagggggcccuccaggagcugaccaaggaggacaacgacuacgaggagaucuucaagaucuccaagaucccccagcccagcgcgaaggagcugcucaaguacaagcuguggcuggagcagaaguaccggagccccuacaccggcaagccgaucucccucagcaagcuguucacguccgccuaccagaucgagcacaucaucccccagagccgcuacuucgacgacuccuucaacaacaaggugaucugcgagagcgaggucaacgcccugaaguccaacaugcucggguacgaguucaucaagaaccacggcggcgagaucgugcacugcacccugcugggggacgugaagguccagaacgagagcgaguacaaggccuucgugaccgagcacuacgccaacaacaaguacaagaaggagaagcuccugauggaggacaucccccaggacuuccugaaccggcaccucaacgacucccgcuacaucagcaagguggucaagacccugcuguccaacaucgugcggacggaggacgagauggagaccaccagcaaguucguggucuccugcaccggcgggaucaccgaccgccucaagaaggacuggggccugaacgacguguggaacagcaucguguacucccgguucgagcgccugaacgagcucaccaagagcgacgcguucgggcgcugggagaacaaggagggcaagcgggucuuccagacguccgugccgcuggagcugcagcgcggcuucaacaagaagcggaucgaccaccgccaccacgccauggacgcccucgugaucgccugcgccagccggaacaucaucaacuaccugaacaacgagagcgcgaacucccccaagaagcgcgaggaccugcggcagcagcucugcgacaagaaccgcaucauccggaagcccugggagagcuucacccaggacgcccgcgccgcccuggaggacgucgugguguccuucaagaacuacguccgggugaucaacaagaccacgaacuacuacgagcgcuacggggcggacggcgagaagaccaucgccaagcagaagaacagcgagaugugggccgugcggaagcccaugcacgaggccaaguacuacgggcgcgucaaccugcagcggaagaccgaggugcgccucaaggccgcgcuggaggacaucccguccaucugcaacaaggagcugcgggacuacaucaaccgccucgucaagagcggccugaacgcccggcagcugcucgcccacuucaaguccaccgacuacugcuggaacaagcagaacguggacaagguggagguguggcgcuucagcgacgagaaggagccccuggucgccauccgcgagucccuggacacgagcuucgacgccaagcggaucgacaccaucaccgacaccgggauccagaagauccuccugaacuaccuggaggcgaagggcggcgaccccgccaucgccuucacgcccgaggggaucgccgagaugaaccagaacauggcccucuacaacaacggcaagaugcaccagccgauccugcgcgugcggcuguccaagaagcgcgggaagaaguaccaggugggccagaccgggugcaaggcgaagcaguucgucaucagcgaguccggcaccaaccucuacuucgccaucuacgaggacgaggaccggaaccgcaccuacaacacgaucccccugaacgagguggccgagcggcugaagcagggccucagccccgugcccgagaagaacgagaaggaggucccgcugaaguucuaccugucccccaacgaccucguguacgugcccaccgaggaggagauccugaugaaggagugcaagcugaacaagaaccgcaucuacaaguucaucgacagcuccgggaccaccgccaacuucgucccccaccggagcgcgucccucaucuacaacguggacaagaagcuggccgaggccuucugcaacgacgagaucauccagaacgaguacggcguggggagcccgcagagcaagaaccagaaggcccugacgggcgagaugaucaaggccgucugcuggaagcucgagguggaccgccuggggaacaucauccgggugaucaaguga

SEQ ID NO: 2254 - RNA, 4515 nt, Artificial Sequence
  Cas9 variant
augaagaacaucgugggccuggaccucgggaccaacagcaucggcugggccgucgugaacgggaacaucaacgacgacggcuccgagcagcuggugaagauccaggccagcgggucccgcaucauccccauggacgcggccaugaucggcgacuucaacaagggcaacagcaucucccagaccgccgagcggacgcgccugcgggggauccgccggcucagcgagcgcuaccugcugcggcgcgagcggcuccaccgcauccuggacauccugggcuuccucccgucccacuucgcccgggaccuggaccgcuacgggaagaucgucaaggacaaggagcccaagcuggccuggcggaagaacgaggcgggccaguucgaguucaucuuccagaacagcuucaaggagaugcucgaggacuucaagcugaaccaccccaaccugaucaccgacgacaagaaggugcccuacgacuggaccaucuacuaccuccgcaagaaggggcugaccuccaagaucagcaaggaggagcuggccuggauccuccugaacuucaaccagaagcggggcuacuaccagcugcgcggcgaggaggaggaggagaacaagaacaagcaggucgaguucuacgcccucaaggugaucgccguggaggacuccggggagaagaagggcaaggacacgugguacaacgugcaccuggagaacggguggaucuaccggcgcaccagcaacaugccgcuggacugggucggcaagaccaaggaguucaucgugaccacggaccucgagaaggacggcacccccaagaaggacaaggaggggaacaucaagcgguccuuccgcgcgcccaaggaggacgacuggagccuggugaagaagaagaccgaggccgacaucgaccagacccacaagacggucggcaccuacaucuacgacacccugcucgggaaccccucccagaagauccggggccgccuggugcgcaccaucgagcggaaguacuacaaggaggagcugaagcucauccuggacaagcagaaggaguuccacccggagcugcaggaccgcgcccucuacgccgccugcguggaggagcuguacacgaucaacgaggcgcaccggaacaacaucgggaaccgcgacuucaccuaccuguuccucgaggacauccuguucuaccagcggccccucaagagcaagaagucccugaucgacaacugccccuacgaggagaaccacugccuggacaaggagaccggcgagaucaaguucuuccccgucaagugcaucgccaagagccacccgcuguuccaggaguuccgccucuggcaguucaucgugaaccugcggaucuaccgcaagggccuggcccaggacguggacgucaccaacgagcuccugaagacggaggaggacuacguggcccuguucgacuggcucaacgggaagaaggagaucgaccagaaggccuuccugaaguacccgcccuucggccugaagaaggagguggagaacuaccgguggaacuacguccaggacaaguccuaccccugcaacgagacccgcagccugaugcucgcgcggcuggagaagugcgacaucagcaucgaguuccugaccaaggagaacgaggaggcccucuggcacauccuguacuccguggaggacaagaacgagaucgugaaggcccugcagaaguucgccgacaagcacaaccucaacgccagcuucgucgacguguuccagaaguuccccuccuucaagaaggaguacgggagcuacuccgcgaaggccaucaagaagcugcugccccucaugcgcaugggcaaguacuggagcgaggacuccaucgacaaggggacccgggagcgcauggacaagaucaucacgggcgaguacgacgagaagaucgagaaccggguccgcgagaaggccauccaccuggccgacaucagcgaguucaagggccugccccucuggcuggugugcuacaucguguacgggcggcacuccgagagcaaggagaucgccaagugggagucccccgcggacaucgacagcuaccugaaguccuucaagcagcacagccuccgcaacccgaucgucgagcagaucaucaucgagacccugcggguggugcgcgacaucuggaagcaggucggcaacaucgacgagauccacguggagcuggggcgcgagaugaagaaccccgccgacaagcggcgcaagaugacccagcagaucuccgagaacgagaacaccaaccuccggaucaaguaccugcugacggaguuccucaaccccgaguacgagguggagaacguccgccccuacagcccgucccagcaggacauccugcggaucuacgaggagggcgugcugaacagcguguccaaccuccccgaggagaucagcgacauccugaagaaguucaccgagaccgaccugaagaagcgccccagccgguccgagguccuccgcuacaagcuguggcuggagcagaaguaccggagccccuacaccggggaggugaucccgcucggcaagcuguucacgcccgccuacgagaucgagcacgugaucccccagucccgcuacuucgacgacagcuucuccaacaaggucaucugcgaggccgaggugaacaagcucaagagcaaccugcugggccacgaguucaucgugaagcaccacggggagaucgucgagcugccguucggcaagaaggugaagaucuucaccguggacgaguacgagcaguucgucaaggacaacuacucccggacccgcgggaagaugaagaagcuccugguggacgacauccccgaggaguucguggcgcggcagcugaacgacagccgcuacaucuccaaggucgucaagagccuccuguccaacaucgugcgggagaagggcgaggaggaggccaucagcaagaacgugauccccugcaccggcggggugacggaccgccugaagaaggacuggggcgugaacgacgucuggaacaagaucauccucccccgguuccagcgccugaacgagcugaccgggaccaacaaguucaccaccaugucccucaacaaccacgagaucccggccaugccccuggagcugcagaagggcuucaacaagaagcggaucgaccaccgccaccacgccauggacgccaucaucaucgcgugcgccaaccggaacaucaucaacuaccucaacaacgagagcgccacggccaaggccgagcugucccgcuacgaccugcagcgccuccugugcgacaaggcgaagaccgacgacaacgggaacuacaagugggugauccggaagcccugggccagcuucacccaggacgugcacggcguccuggaggacaucaucguguccuucaagcagaaccuccgcgugaucaacaaggccaccaaccacuuccugcacuacaacgaggagggcaagaagaucuucgucaagcaggagaagggggacagcugggccauccgcaagagcaugcacaaggacacgguguucggcgaggugaaccugcggcggaucaagaccgucgcccucaacgaggcgaugaagaacccccaguccaucguggugaaggacuucaagcgcaagcugcuggagcuccugaaccugggguucgacgccaagcggaucaagaaguacuucgaggacaaccgcgagaccuggagcgacaucaaccucuccaagaucaccgucuacuacuucagcaaggacacgaaggaccgguucuucgccacccgcaagccgcuggacaccuccuucgaccggaagaagaucgagaacaacaucaccgacacgggcauccagaagauccugcuccgccaccuggagcugaaggacaacaaccccgacaucgccuucagccccgacgggaucgacgagaugaaccggaacaucauccagcucaacaacggcaaguaccaccagcccaucaucaaggugcgcugguacgagcaggcggacaaguucgccgugggccagaccgggaacaaguccagcaaguucgucgaggccgccaagggcaccaaccuguucuucgccguguacgaguccaacauccuggacgagaagaccaacacgaucaucaagaagcggaacuacgcgaccaucccgcucaacguggccaucgagcgccagaagcaggggcugagcgucgcccccgaggaggagaacggcaacgaccccaucuucgugcugucccccaacgaccucguguaccugccgaccaccgacgagcuggccaacggggucguggcccagccccucgacaaggagcggaucuacaagauggucagcugcacgggcaacgagggccacuucauccccgcgcgcaucgccaaccccauccugcagaccaucgagcugggguccaacaacaaggcccagaaggccuggaccgacgagaugaucaaggagaucugcaugccgaucaagguggaccggcucggcaacauccuggagagcuccagccugcacaagaaguga

SEQ ID NO: 2255 - RNA, 4515 nt, Artificial Sequence
  Cas9 variant
augaagaacaucgugggccuggaccucgggaccaacagcaucggcugggccgucgugaacggguccgugaacgacgacggcagcgagcagcuggucaagauccaggccuccgggagccgcaucauccccauggacgcggccaugaucggcgacuucaacaagggcaacuccaucagccagaccgccgagcggacgcgccugcgcggggugcggcggcucuccgagcgcuaccugcugcggcgcgagcggcuccaccgcauccuggacauccugggcuuccucccguuccacuucgcccaggaccuggaccggcacgggaagaucgugaagggcaaggagcccaagcuggccuggcgcaagaacgaggcggggcaguucgaguucaucuuccaggacagcuucaaggagaugcucgaggacuucaagcugaacuaccccaaccugaucaccgacgacaagaagguccccuacgacuggaccaucuacuaccuccggaagaagggccugaccuccaagaucagcaaggaggagcuggccuggauccuccugaacuucaaccagaagcgcggcuacuaccagcugcgcggggaggaggaggaggagaacaaggacaagcucguggaguucuacgcccugaagguggucgccguggaggacuccggcgagaagaaggggaaggacaucugguacaacgugcaccuggagaacggcugggucuaccggcggacgagcaacaugucccucgacugggugggcaagaccaaggaguucaucgugaccaccgaccuggagaaggacgggacgccgaagaaggacaaggagggcaacgucaagcgcagcuuccgggcgcccaaggaggacgacuggucccuggugaagaagaagaccgaggccgacaucgaccagacccacaagaccgugggggccuacaucuacgacacgcuccugggcaaccccagccagaagauccgcgggcggcugguccgcaccaucgagcgcaaguacuacaaggaggagcucaagcugauccuggagaagcagaaggaguuccaccucgagcugcaggaccgggcccuguacgccgcgugcaucgaggagcucuaccccaucaacgaggcccaccgcaacaacgugggcaaccgggacuucaccuaccuguuccuggaggacauccucuucuaccagcgcccgcugaaguccaagaagucccugaucgacaacugccccuacgaggagaaccagggccucgacaaggagaccggggagaucaagagcuuccccgugaagugcaucgccaagagccacccccuguuccaggaguuccggcuguggcaguucaucaucaaccuccgcaucuaccggaaggaccuggcccaggacgucgacgugacgaacgagcugcucaagaccgaggaggacuacguggcccuguucgacuggcugaacggcaagaaggagaucgaccagaaggcguuccugaaguacccggucuucgggcucaagaaggagaucgagaacuaccgcuggaacuacgugcaggacaagcccuaccccugcaacgagacccggagccugaugcuggcccgccucgagaagugcgacaucuccaucgaguuccugaccaaggagaacgaggaggcccuguggcacauccucuacagcgucgaggacaagaacgagaucgugaaggcccugcagaaguucgccgacaagcacgaccugaacgcguccuucguggacgucuuccagaaguucccgcccuucaagaaggaguacggcagcuacuccgccaaggccaucaagaagcuccugccccugaugcggauggggaaguacuggagcgagaacuccaucgacaagggcacgcgcgagcggaucgacaagaucaucaccggcgaguacgacgagaagaucgagaaccgcgugcgggagaaggccauccaccucgccgacgugagcgacuucaaggggcugccccuguggcucgucugcuacaucguguacggccgccacuccgaggcgaaggagaucauccaguggaagucccccgccgacaucgacagcuaccugcggagcuucaagcagcacucccugcgcaacccgaucguggagcagaucaucaucgagacccuccgggucgugcgcgacaucuggaagcaggucgggaacaucgacgagauccacguggagcugggccgcgagaugaagaaccccgccgacaagcggaagaagaugacccagcagaugagcgagaacgagaacacgaaccugcgcaucaaguaccuccugaccgaguuccugaaccccgaguacgagguggagaacgugcggcccuacuccccgagccagcaggacauccuccgcaucuacgaggaggggguccugaacuccgugagcgaccugcccgaggagaucuccgacauccucaagaaguucaccgagaccgaccugaagaagcggcccagccgcagcgaggugcugcgguacaagcucuggcuggagcagaaguaccgcucccccuacacgggcgaggucaucccgcugggcaagcuguucacccccgccuacgagaucgagcacgugaucccccagagcugcuacuucgacgacuccuucagcaacaaggugaucugcgaggcggaggucaacaagcucaaguccaaccugcucgggcacgaguucaucgugaagcaccacggcgagaucguggagcugccguucgggaagaagguccggaucuucaccguggacgaguacgagcaguucgugaaggacaacuacagccgcacccgguccaagaugaagaagcugcucauggacgacauccccgaggaguucgucacgcgccagcugaacgacagccgguacaucuccaagguggucaagagccugcucuccaacaucgugcgcgagaagggcgaggaggaggccaucagcaagaacgugauccccugcaccggcggggugaccgaccggcugaagaaggacuggggcaucaacgaggucuggaacaagaucauccugccccgcuuccagcggcucaacgagcugaccgggacgaacaaguucaccaccaagaacgugggcauccaggagaucccgaccaugccccuggagcuccagaagggguucaacaagaagcgcaucgaccaccggcaccacgccauggacgccaucaucaucgccugcgcgaaccgcaacaucaucaacuaccugaacaacgaguccgccaccgccaaggccgagcugagccgguacgaccuccagaagaugcugugcgacaaggccaagacggacaacaacggcaacuacaagugggugauccgcaagcccugggcguccuucacccaggacaccuaccuggcccucgagaacaucaucgucagcuucaagcagaaccugcgcgugaucaacaaggccaccaaccgguuccugcacuacaacgaggagggcaagaagaucuucgugaagcaggggaagggcgacaacugggccauccgcaaguccaugcacaaggacacggucuucggggaggugaaccuccggcgcaucaagaccguggcccugaacgaggcgaugaagaacccccagagcaucgucgugaaggacuucaagcggaagcugcucgagcuguggaaccugggcuucgacgccaagcgcaucaagaaguacuucgaggacaaccgggagaccuggagcgacaucaaccucuccaagaucgagguguacuacuucagcaaggacaccaaggaccgcuucuucgccacgcggaagccgcuggacaccuccuucgaccgcaagaagaucgagaacaacaucaccgacaccgggauccagaagauccugcuccggcaccuggagcugaaggacaacaaccccgacaucgccuucagccccgacggcaucgacgagaugaaccgcaacaucauccagcucaacaacggcaaguaccaccagcccaucaucaagauccggugguacgagcaggcggacaaguucgccgucgggcagacgggcaacaaguccagcaaguucguggaggccgccaaggggaccaaccuguucuucgccguguacgaguccaacauccuggacaagaagaccaacaccaucaucaagaagcgcaacuacgcgacgaucccgcucaacgucgccaucgagcggcagaagcagggccugcccguggcccccgaggacgagaacgggaacgaccccaucuucgugcugagcccgaacgaccucgucuaccugcccaccgacgacgagcuggccaacggcaucaucgcccagccccucgaccgcggccggaucuacaagaugguguccagcuccggggagcagugcuucuucaucaagcacaucgucgcgaacgugcugguggacaaguucgaguucagcccccugaacaagauggagcgcgcccucaccggcgagaugaucaagaugaucugcaucccgaucaaggucgaccggcuggggaacgugcuggaguccagcuccagcuacaagaaguga

SEQ ID NO: 2256 - RNA, 4515 nt, Artificial Sequence
  Cas9 variant
augaagaacaucgugggccuggaccucgggaccaacagcaucggcugggccgucgugaacggguccgugaacgacgacggcagcgagcagcuggucaagauccaggccuccgggagccgcaucauccccauggacgcggccaugaucggcgacuucaacaagggcaacuccaucagccagaccgccgagcggacgcgccugcgcggggugcggcggcucuccgagcgcuaccugcugcggcgcgagcggcuccaccgcauccuggacauccugggcuuccucccguuccacuucgcccaggaccuggaccggcacgggaagaucgugaagggcaaggagcccaagcuggccuggcgcaagaacgaggcggggcaguucgaguucaucuuccaggacagcuucaaggagaugcucgaggacuucaagcugaaccaccccaaccugaucaccgacgacaagaagguccccuacgacuggaccaucuacuaccuccggaagaagggccugaccuccaagaucagcaaggaggagcuggccuggauccuccugaacuucaaccagaagcgcggcuacuaccagcugcgcggggaggaggaggaggagaacaagaacaagcucguggaguucuacgcccugaagguggucgccguggaggacuccggcgagaagaaggggaaggacaucugguacaacgugcaccuggagaacggcugggucuaccggcggacgagcaacaugccgcucgacugggugggcaagaccaaggaguucaucgugaccaccgaccuggagaaggacgggacgcccaagaaggacaaggagggcaacgucaagcgcuccuuccgggcgcccaaggaggacgacuggagccuggugaagaagaagaccgaggccgacaucgaccagacccacaagaccgugggggccuacaucuacgacacgcuccugggcaaccccucccagaagauccgcgggcggcugguccgcaccaucgagcgcaaguacuacaaggaggagcucaagcagauccuggagaagcagaaggaguuccaccuggagcuccaggaccgggcccuguacgccgcgugcaucgaggagcuguacccgaucaacgaggcccaccgcaacaacgugggcaaccgggacuucaccuaccucuuccuggaggacauccuguucuaccagcgcccccucaagagcaagaagucccugaucgacaacugccccuacgaggagaaccagggccuggacaaggagaccggggagaucaagagcuuccccgugaagugcaucgccaagucccacccccucuuccaggaguuccggcuguggcaguucaucaucaaccugcgcaucuaccggaaggaccucgcccaggacgucgacgugacgaacgagcugcugaagaccgaggaggacuacguggcccucuucgacuggcugaacggcaagaaggagaucgaccagaaggcguuccugaaguacccggucuuccgccugaagaaggagaucgagaacuaccgguggaacuacgugcaggacaagcccuaccccugcaacgagacccgcagccucaugcuggcccggcuggagaagugcgacaucagcaucgaguuccucaccaaggagaacgaggaggcccuguggcacauccuguacuccgucgaggacaagaacgagaucgugaaggcccuccagaaguucgccgacaagcacgaccugaacgcgagcuucguggacgucuuccagaaguucccgcccuucaagaaggaguacggguccuacagcgccaaggccaucaagaagcugcucccccugaugcgcaugggcaaguacugguccgagaacagcaucgacaaggggacgcgggcccgcaucgacaagaucaucaccggcgaguacgacgagaagaucgagaaccgggugcgcgagaaggccauccaccuggcggacguguccgacuucaagggccucccccuguggcuggucugcuacaucguguacgggcggcacagcgaggccaaggagaucauccaguggaaguccccggccgacaucgacagcuaccuccgcuccuucaagcagcacagccugcggaaccccaucguggagcagaucaucaucgagacccugcgcgucgugcgcgacaucuggaagcaggucggcaacaucgacgagauccacguggagcucgggcgggagaugaagaaccccgccgacaagcgcaagaagaugacccagcagauguccgagaacgagaacacgaaccugcggaucaaguaccugcucaccgaguuccugaaccccgaguacgagguggagaacgugcgcccguacagccccucccagcaggacauccugcggaucuacgaggagggcguccucaacagcguguccgaccugcccgaggagaucagcgacauccugaagaaguucaccgagaccgaccucaagaagcgccccucccggagcgagauccugcgcuacaagcuguggcucgagcagaaguaccggagcccguacacgggggaggugaucccccugggcaagcuguucacccccgcguacgagaucgagcacgucaucccgcaguccugcuacuucgacgacagcuucuccaacaaggugaucugcgaggccgaggugaacaagcucaagagcaaccugcugggccacgaguucaucgucaagcaccacggggagaucguggagcuccccuucggcaagaaggugcgcaucuucaccgucgacgaguacgagcaguucgugaaggacaacuacucccggacccgcagcaagaugaagaagcugcugauggacgacauccccgaggaguucgugacgcggcagcucaacgacucccgcuacaucagcaaggucgugaagucccugcugagcaacaucgugcgggagaagggggaggaggaggccaucuccaagaacgucauccccugcaccggcggcgugaccgaccgccucaagaaggacugggggaucaacgagguguggaacaagaucauccugccgcgguuccagcgccugaacgagcucaccggcacgaacaaguucaccaccaagaacgucgggcugcaggagauccccaccaugccccuggagcuccagaagggcuucaacaagaagcggaucgaccaccgccaccacgccauggacgccaucaucaucgcgugcgccaaccggaacaucaucaacuaccugaacaacgagagcgccaccgccaaggccgagcugucccgcuacgaccuccagaagaugcugugcgacaaggcgaagacggacaacaacgggaacuacaagugggugauccgcaagcccugggccagcuucacccaggacaccuaccuggcccucgagaacaucaucguguccuucaagcagaaccugcgggucaucaacaaggccaccaaccgcuuccugcacuacaacgaggagggcaagaagaucuucgugaagcagggcaagggggacaacugggccauccgcaagagcaugcacaaggacacgguguucggcgaggucaaccuccggcggaucaagaccguggcgcugaacgaggccaugaagaacccgcaguccaucguggucaaggacuucaagcgcaagcugcucgagcuguggaaccugggguucgacgccaagcggaucaagaaguacuucgaggacaaccgcgagaccuggagcgacaucaaccucagcaagaucgagguguacuacuucuccaaggacaccaaggaccgguucuucgccacgcgcaagccccuggacaccagcuucgaccggaagaagaucgagaacaacaucaccgacaccggcauccagaagauccugcuccgccaccuggagcugaaggacaacaaccccgacaucgcguucucccccgacgggaucgacgagaugaaccggaacaucauccagcucaacaacggcaaguaccaccagccgaucaucaaggugcgcugguacgagcaggccgacaaguucgccgucggccagacggggaacaaguucagcaaguucguggaggccgccaagggcaccaaccuguucuucgcgguguacgaguccaacauccuggacaagaagaccaacaccaucaucaagaagcggaacuacgccacgaucccccucaacgucgccaucgagcgccagaagcaggggcugcccguggcccccgaggacgagaacggcaacgacccgaucuucgugcugagccccaacgaccucgucuaccugcccaccgacgacgagcuggccaacgggaucaucgcgcagccccucgaccggggccgcaucuacaagaugguguccagcuccggcgagcagugcuucuucaucaagcacaucgucgccaacgugcugguggacaaguucgaguucagcccgcugaacaagauggagcgggcccucaccggggagaugaucaagaugaucugcauccccaucaaggucgaccgccugggcaacgugcuggaguccagcuccagccacaagaaguga

SEQ ID NO: 2257 - RNA, 4515 nt, Artificial Sequence
  Cas9 variant
augaagcgcauccugggccucgaccuggggaccaacagcaucggcugggcccugaucgagaacgacuucaaccggaaggaggggaagaucgaggcccucggcucccgcaucauccccaugagccaggacauccuggggaaguucgacuccggcgugaccgucagccagacggcggcccggaccaacuaccgcggcauccggcgccuguaccagcgggacaaccuccgccgggagcgccugcaccgggugcugaacauccucggguuccugccgaagcacuacgccgaguccaucgacuucgaggaccgccugggccaguucaagcccgagaccgaggugaagcuccccuaccggaaggacagcgacgacaacuaccacuucaucuuccaggaguccuucaacgagauggucgaggaguuccaguucaagaaccccagccuguucuacaccaaggccaacggggagcaguccaagaucccguacgacuggacgcuguacuaccuccgcaagaaggcccugagcaagaagaucuccaaggaggagcuggcguggauccuccugaacuucaaccagaagcggggcuacuaccagcugcgcggggaggaggaggccgacagcaaggacaagcucgaggaguaccacgcccugaagguguccgacgugcaggccaccgaggacaccaacgcgaagggcaccugguacaacgucauccuggagaacggcuggaucuaccggcgccagagcaaggacucccucuucgacuggaaggggaagacgcgggaguucaucgugaccaccagccuggagaagggcggggccgugaagaucgacaaggagggcaacgagaagcgcuccuuccgggccgucgacagcgagaaggacuggaucgccaucaagaagaagaccgagaacgaccuggccaacgcgggcacgaccguggggguguacaucuacgagacccuccugcgcaaccccgaccagaagauccgcggcaagcugaucaagaccaucgagcggaaguacuaccucgaggagcugaaggccauccuggccaagcagauccaggagcacgccgagcuccagaaccgcucccuguacaaggacugcaucgaggagcuguaccaggggaacgaggcccacaagaacaacaucaaggagaacggcuucgacuaccucuuccuggaggacaucaucuucuaccagcggccccucaagagcaagaaguccacgaucagcaacugccccuacgagagccgcgucuucaucaaggacgggaagaaggagauccagccgaucaagugcaucuccaagagcaaccccaucuaccaggaguuccggcuguggcaguucauccacaaccugaagaucuacgagaaggaggcgaucgacgacggcaagaccgugaucaacaaggacgugaccaccgaguuccugaacacgcaggaggccuacgccgcccucuucgaguuccugaacgacaaggccgagaucucccagaacgcgcugcucaaguacuucaagcugagcaccaacacccaccgcuggaacaacgucgaggacaagaaguaccccugcaacgagacccgguccgaguucaucaagcgccugagcaagauggacggcaucgaccucgggaagacgcugucccccgccuucgagaagucccuguggcacaucaucuacagcgugaaggacaagaagcaguacgugcgggcccuggagaccuucgccaugaagaacggccucgacaucaaccaguuccgcgagaacuucgagaaguucaagccguacgacagcgccuacggggcguacuccgagaaggcccugaagaagguccugccccucauccggcgcggcaccuacuggaagaaggacgccauccccgccgcggugcaggagcggaucgugaacaucaugaagcgcaucgagagcgucgacuucaaccuggagaagaucgagaacuucgccgacgacgacauccccaagcagcugcucaaguccuucgccaaggggaaggacccgaugcagggccugaacaccuaccaggccugcuacgccguguacaaccggcacagcgagguguccgacauccagcuguggaagucccccgaggacaucacgaaguaccucgacagcuucaagcagcacagccugcgcaaccccaucgucgagcaggucgugauggagacccugcggguggugcgcgacaucuggcaguacuacggcaacggggcgaaggacuucuucagcgagauccacgucgagcucggccgggagaugaagaacgacaagaagacccgcgagcgcaucuccaagagcaucaccgagaacgagaacacgaacgagcggaucaagaacauccugaaggagcugaugggggacgaggcccuccagggcgacauccgccccuacuccaaggggcaccaggacauccugaagcuguacgaggagggcguguucgccaacgccccggagaccuacaagaacaucaagaucgacgacaucgagaagauccggaagaacaacagccccuccaagagcgacaucgugaaguacaagcucuggcuggagcagggcuacaucucccccuacaccgggagccccaucccgcugucccgccucuucaccacggacuaccagaucgagcacaucaucccccggagccgcuacuucgacgacuccaugggcaacaagaucaucugcgagagcgccgucaacgaggagaagaccaacaagaccgcguacgaguucaucaaggagaacgccgggcggaucaucgaccugggccagggcaagcaggucccccuguucgaccucgaggccuacgagucccacugccgcggguacuucaagggcaacaccaagaagcugaaguuccugcucagcgaggacauccccgagggguucaucaaccggcagcugaacgacucccgcuacaucagcaagguggugaccucccugcucagcaacguggugcgggaggagggcgagcaggaggccacgagcaagaaccuggucccgcugguggggaccaucaccuccaagcucaagaaggacuggggccuggaggccaucugggacgaccugaucgcgccccgcuucgagcggaugaaccagcucaccaagagcacggacuuccgcaaggaggugaucgacggccacgggaaccgguacuucaucaacaccguccccgacgacaucaagaagggcuucuccaagaagcgcaucgaccaccggcaccacgcccuggacgcccuggugaucgccugcaccaccaaggaccacgugaacuacaucacgagccucaacacccagcgcaacaaccggucccuggucagcaagcugcgcaagaucgaggagaagaccaucaaggacaagcggaccgggcagccgaagacgaucaagaucgcgaaggccuaccacaagcccuggcccaacuucaccaaggagaccuucgagaagcucuccaagaccguggugagcuucaagcagaaccagcgcaucaucaacaagacgaacaacaagaccuggggcugggagaaggucgacggggugaugaagaaggugcugaagaagcaggagaagcgcaacugggccauccggaagcccauccacaaggagaccuacuacggcaaggucaagggcuucgacuccccgaaggggaagaucaccacggccacccgcaagagccugcgggagaucaccaacgagcgccagcucaacaccaucacggacuccggcaucaagaagauccugaacaaccaccugaagaccuucaucgacgagagcgggaagaucaacuucgagcccgccuucaaccaggacggcaucgaccuccugaacaagaacauccagcagcugaacgaggggaagaaccaccagcccaucuacaaggugcggauguacacccacaacaccauguucuccgugggcgacgagggcaacaagagcacgaaguacgucauccccgaguccgggaccaaccucuucuucaacguguacugggacgaggagaacaacaagcgcaacuucgagaccgugccgcugaaccgggucaucgcguuccagaagcagaccagccacaucccccgcaaggaccggacggacgugcccaucgacaacacccugggccgcuuccucuucacccugucccccgacgaccugguguaccucccgaccgacgaggagagcgaguccuucacgaccuucgagaucgacagccugaacagcaagcaggucgccaacaucuacaaguucguggacggguccggcaccaccgggaacuucgugcccgccgaggccgcccgggucaucgcgaacaucaaggacaagaaggugcgcagcaacuucugcaagcggaacaaccuguccgacaagcagcucaucaagaacgaguucggccugggcagcccccagcugaagaaccagaacucccucgacgggcgccagaucaagagcaucugcuggaagcuggagaucaaccggcugggcaagaucaucaaggugaucaaguga

SEQ ID NO: 2258 - RNA, 4515 nt, Artificial Sequence
  Cas9 variant
augaagaaggugcugggccucgacaucgggaccaacagcgucggcugggccguggugaaccagaacgacaagggggaguuccuguccaucgagaagaucggcagccgcaucauccccaugucccaggacgucauggacaaguucggggccggccagaccgagagcuccacggcgcagcggacccaguaccgcggcgugcggcgccugcgggagcgcagccuccugcggcgcgagcggcugcaccgcgugcuccacauccugcacuuccugccgcagcacuacgacgccgccaucggguggaacaagaaggagaacaagaccuacggcaaguuccuccccggggucgaggugaacauccccuggguggccaccgaccagggccaccaguucaucuucauggacuccuacgccgagaugcugaaggaccugaagcagcaccagccccaccucuucgagaaguccagcacgccggucccccuggacuggaccaucuacuaccugcggaagaaggcgcucacccaggccaucagcaaggaggagcuggccuggauccugcucaacuucaaccagaagcgcggguacuaccagcugcggggcgaggagguggaggacaacaccaagcgcgaggaguucuacgcccugaagguggucaagguggagcucgacaaggacaacacguccgcgaagaccugguacaaggugcaccuggagaacggcuucaucuaccccugccccagcgacaccccgaucgacuccugggucgggauggugaaggacuucaucgugaccacgacccuggagaaggacggcagcgagaagcggaccgccgacggggagaucaagcgcuccuuccgggcccccaaggaggacgacuggacccuccugaagaagaagacggagagcgagcuggagaaguccggcaagcaggucggcgccuucaucuacgacacccuccugagcaaccccgaccagaagaucaucgggggccugaucaagaccaucgagcgcaaguacuacaagaaggagcucgagcagauccuggagacccagcagaaguucaucgccgagcuguccgacaagaagcuguuccaggcgugcgccgaggagcuguacccccugaacgacagccaccgggagaaccuccuggagcgcgacuucaagcaccuguucgugcaggacaucaucuucuaccaccggccgcucaagacgaagaagucccugaucagcaacugcaccuacgaguaccgcaccuucuacaagaacggggagaagcagaucagccccaucaagugcaucgccaaguccaacccccuguuccaggaguuccgcguguggcaguucguccagaaccuccggauccugcagcgccagcggagcgagggcgacuccaucaaguacaacguggacgugaccgccgaguuccugaaggacgagaacgacaucgccaaccucuucacguggcugaacgagcgcaaggucaucaagcaggaccagcugcucaagagcuacuucaagcugaaggugaacaaggagaccaaggagcuggacuaccgguggaacuacgucgacgacaagaacaaggaguaccccugcaacgcgacccgcacccacauccuguccuuccucgagaagugcaaggaggagaagcggaucgaggacgaccgcuucguguacagccuguggcaccuccucuacuccguggucgagccgaucgagcugcgcggggcccuggccaaguucgccgagcgggagcaccuccaccccagcuucguggacguguucgcccaguucccgccccuggagaaggaguacggcuccuacagcgagaaggcgaucaagcggcugcucccccugaugcgcaugggcgacuacuggcacgaggacaagaucgacgucaagacgaagcagcggauccagcgcaucaucgacggggaggccgacgacgacaucacccaccggucccgcgagaagguggagaaccugcggagcaucaccgacuucaagggccucccccuguggaaggccggguacguggucuacaaccgccacuccgagagcggcgagcugaccaaguggaagacgccccacgagcucuccaacuacauccagaacgaguucaagcaguacagccugcggaaccccaucguggagcagaucgugcuggagacccuccgcgucgugcacgaccugugggugaagcacggggacuucuccgagauccaccuggagcucggccgcgacaucaagaacagcagcgacaagcggaagcgcauggccgagcggcagcaggagaacgagaacucccgccagcggguccuggagaugcugaucgaccucaagaaggaggccgcguucgccgaccugaacccguacagccccucccagcaggagaagcugcgcaucguggaggacggcgugcuccggagcaacaucgagauccccaaggacaucgagaagaucaccaaguccgccaagcccaccagccgcgagcugacgaaguaccggcuguggcucgaccagaaguaccgcuccccguacaccgggcagcccaucagccuggcccagcuguucaccuccaaguacgagaucgagcacgucaucccccaggcgaaguacuucgacgacagcuucaccaacaaggugaucugcgaguccgaggugaacaaggagaagggcagcaugcucgcccacgaguucauccugaagaacgggggcuccaccgucaacgugggcgggcgccaggugcagguccugaagaacgacgccuacguggagcucaucaaccggcuguacggcaagaacaacccggugaaggccaagaagcugcucgccgaggacaucgacgaggucgugggggacuucagcgagcggcagcugaacgacacgcgcuacaucucccgggugguccagaagcugcucagcaacaucgugcgcgaggaggacgagcaggaguccaccagcaagcacgugaucggcugcagcgggcaggucaccaccgcgcugaagaaggacuggggccugaacgacaucuggaacaagaucauccagccccgguucgagcgccucaacgagaugacggccaccgaggacuacggcguguggcagucccccaaccacuuccagauccgggugcccgaggagauccagaagggguucaccaagaagcgcaucgaccaccggcaccacgccauggacgcccuggucaucgccugcgcgacccgcagccacaucaacuacaucuccaaccgcagcggccaggaccggaacgccaaguucgagacgacccgcaccgaccugcgguccaagcucugcuacaaggagaacagcuccgggaacaacuacaacuacaucuucaacaagccgugggacaccuucacgcaggacgcccaccgcgcccuggagaacaucguggugagccacaagcagaaccugcggguccucaccaagaccaacaacuacacccaguucaucaacaaggacggcaagaaggaccugcagaagcaggucaagggggaccacuucgccgugcgcaagcccaugcaccaggagacgaucuacggccggguguccauccgcagcaucaaggagguggcgcugaagaaggcccucgagaacuggaagcagaucguggaccggacccugaaggacaagauccgcgagcugaucggcgccuacgggaaguacgacgcccagaccauccucaaguacuucaaggaccgggacuacaaguucaacaaccugaagaucaaccgcgucgagguguacgaguacgaccacaacugcgcggccgugcggaaguccaucggcgacgaccugaccaucaagcagaucgagcgcaucacggacgagagcauccggaagauccucaugaaccaccuguccaacuacgacgacaaccugaaggaggccuucagccccgaggggcucauggagaugaacaagaacaucaaggagcugaacggcgggaagaaccaccagcccaucuacaagguccgccuguucgaggaccucggcuccaaguucccgcugggcgugagccacaacaaccccgacaaguacgccaucgccgcgaaggggaccaaccuguucuucggcaucuacgaggaccaggaggggaagcggauguucgacuccaucccccucaacaucgugaucgaccgccugaaggagaagaagucccccgucccggagaccuacaacgagagcaagcugaaguuccaccucagccccaacgaccugguguacguccccaccgacgaggagcagaagcagcccgagcugguggacguggaccaccucagcgacgagcagaagggccgggucuacaaggccguguccuucacggggaaccgcgccuucuucgugaaccaccgcgucagcaaggugauccacgacuacguggaguucggcaccaagaacaagaucgagaacgacgacgacaagcggucccugaagcacaucugcuggaagcugaaggucaaccgccucggcgagaucaccgacgugaagcgguga

SEQ ID NO: 2259 - RNA, 4515 nt, Artificial Sequence
  Cas9 variant
augaagaacaucgugggccuggaccucgggaccaacagcaucggcugggccgucgugaacggguccgugaacgacgacggcagcgagcagcuggucaagauccaggccuccgggagccgcaucauccccauggacgcggccaugaucggcgacuucaacaagggcaacuccaucagccagaccgccgagcggacgcgccugcgcggggugcggcggcucuccgagcgcuaccugcugcggcgcgagcggcuccaccgcauccuggacauccugggcuuccucccguuccacuucgcccaggaccuggaccggcacgggaagaucgugaagggcaaggagcccaagcuggccuggcgcaagaacgaggcggggcaguucgaguucaucuuccaggacagcuucaaggagaugcucgaggacuucaagcugaacuaccccaaccugaucaccgacgacaagaagguccccuacgacuggaccaucuacuaccuccggaagaagggccugaccuccaagaucagcaaggaggagcuggccuggauccuccugaacuucaaccagaagcgcggcuacuaccagcugcgcggggaggaggaggaggagaacaaggacaagcucguggaguucuacgcccugaagguggucgccguggaggacuccggcgagaagaaggggaaggacaucugguacaacgugcaccuggagaacggcugggucuaccggcggacgagcaacaugucccucgacugggugggcaagaccaaggaguucaucgugaccaccgaccuggagaaggacgggacgccgaagaaggacaaggagggcaacgucaagcgcagcuuccgggcgcccaaggaggacgacuggucccuggugaagaagaagaccgaggccgacaucgaccagacccacaagaccgugggggccuacaucuacgacacgcuccugggcaaccccagccagaagauccgcgggcggcugguccgcaccaucgagcgcaaguacuacaaggaggagcucaagcugauccuggagaagcagaaggaguuccaccucgagcugcaggaccgggcccuguacgccgcgugcaucgaggagcucuaccccaucaacgaggcccaccgcaacaacgugggcaaccgggacuucaccuaccuguuccuggaggacauccucuucuaccagcgcccgcugaaguccaagaagucccugaucgacaacugccccuacgaggagaaccagggccucgacaaggagaccggggagaucaagagcuuccccgugaagugcaucgccaagagccacccccuguuccaggaguuccggcuguggcaguucaucaucaaccuccgcaucuaccggaaggaccuggcccaggacgucgacgugacgaacgagcugcucaagaccgaggaggacuacguggcccuguucgacuggcugaacggcaagaaggagaucgaccagaaggcguuccugaaguacccggucuucgggcucaagaaggagaucgagaacuaccgcuggaacuacgugcaggacaagcccuaccccugcaacgagacccggagccugaugcuggcccgccucgagaagugcgacaucuccaucgaguuccugaccaaggagaacgaggaggcccuguggcacauccucuacagcgucgaggacaagaacgagaucgugaaggcccugcagaaguucgccgacaagcacgaccugaacgcguccuucguggacgucuuccagaaguucccgcccuucaagaaggaguacggcagcuacuccgccaaggccaucaagaagcuccugccccugaugcggauggggaaguacuggagcgagaacuccaucgacaagggcacgcgcgagcggaucgacaagaucaucaccggcgaguacgacgagaagaucgagaaccgcgugcgggagaaggccauccaccucgccgacgugagcgacuucaaggggcugccccuguggcucgucugcuacaucguguacggccgccacuccgaggcgaaggagaucauccaguggaagucccccgccgacaucgacagcuaccugcggagcuucaagcagcacucccugcgcaacccgaucguggagcagaucaucaucgagacccuccgggucgugcgcgacaucuggaagcaggucgggaacaucgacgagauccacguggagcugggccgcgagaugaagaaccccgccgacaagcggaagaagaugacccagcagaugagcgagaacgagaacacgaaccugcgcaucaaguaccuccugaccgaguuccugaaccccgaguacgagguggagaacgugcggcccuacuccccgagccagcaggacauccuccgcaucuacgaggaggggguccugaacuccgugagcgaccugcccgaggagaucuccgacauccucaagaaguucaccgagaccgaccugaagaagcggcccagccgcagcgaggugcugcgguacaagcucuggcuggagcagaaguaccgcucccccuacacgggcgaggucaucccgcugggcaagcuguucacccccgccuacgagaucgagcacgugaucccccagagcuacuacuucgacgacuccuucagcaacaaggugaucugcgaggcggaggucaacaagcucaaguccaaccugcucgggcacgaguucaucgugaagcaccacggcgagaucguggagcugccguucgggaagaagguccggaucuucaccguggacgaguacgagcaguucgugaaggacaacuacagccgcacccgguccaagaugaagaagcugcucauggacgacauccccgaggaguucgucacgcgccagcugaacgacagccgguacaucuccaagguggucaagagccugcucuccaacaucgugcgcgagaagggcgaggaggaggccaucagcaagaacgugauccccugcaccggcggggugaccgaccggcugaagaaggacuggggcaucaacgaggucuggaacaagaucauccugccccgcuuccagcggcucaacgagcugaccgggacgaacaaguucaccaccaagaacgugggcauccaggagaucccgaccaugccccuggagcuccagaagggguucaacaagaagcgcaucgaccaccggcaccacgccauggacgccaucaucaucgccugcgcgaaccgcaacaucaucaacuaccugaacaacaaguccgccaccgccaaggccgagcugagccgguacgaccuccagaagaugcugugcgacaaggccaagacggacaacaacggcaacuacaagugggugauccgcaagcccugggcguccuucacccaggacaccuaccuggcccucgagaacaucaucgucagcuucaagcagaaccugcgcgugaucaacaaggccaccaaccgguuccugcacuacaacgaggagggcaagaagaucuucgugaagcaggggaagggcgacaacugggccauccgcaaguccaugcacaaggacacggucuucggggaggugaaccuccggcgcaucaagaccguggcccugaacgaggcgaugaagaacccccagagcaucgucgugaaggacuucaagcggaagcugcucgagcuguggaaccugggcuucgacgccaagcgcaucaagaaguacuucgaggacaaccgggagaccuggagcgacaucaaccucuccaagaucgagguguacuacuucagcaaggacaccaaggaccgcuucuucgccacgcggaagccgcuggacaccuccuucgaccgcaagaagaucgagaacaacaucaccgacaccgggauccagaagauccugcuccggcaccuggagcugaaggacaacaaccccgacaucgccuucagccccgacggcaucgacgagaugaaccgcaacaucauccagcucaacaacggcaaguaccaccagcccaucaucaagauccggugguacgagcaggcggacaaguucgccgucgggcagacgggcaacaaguccagcaaguucguggaggccgccaaggggaccaaccuguucuucgccguguacgaguccaacauccuggacaagaagaccaacaccaucaucaagaagcgcaacuacgcgacgaucccgcucaacgucgccaucgagcggcagaagcagggccugcccguggcccccgaggacgagaacgggaacgaccccaucuucgugcugagcccgaacgaccucgucuaccugcccaccgacgacgagcuggccaacggcaucaucgcccagccccucgaccgcggccggaucuacaagaugguguccagcuccggggagcagugcuucuucaucaagcacaucgucgcgaacgugcugguggacaaguucgaguucagcccccugaacaagauggagcgcgcccucaccggcgagaugaucaagaugaucugcaucccgaucaaggucgaccggcuggggaacgugcuggaguccagcuccagcuacaagaaguga

SEQ ID NO: 2260 - RNA, 4515 nt, Artificial Sequence
  Cas9 variant
augaagaacaucgugggccuggaccucgggaccaacagcaucggcugggccgucgugaacggguccgugaacgacgacggcagcgagcagcuggucaagauccaggccuccgggagccgcaucauccccauggacgcggccaugaucggcgacuucaacaagggcaacuccaucagccagaccgccgagcggacgcgccugcgcggggugcggcggcucuccgagcgcuaccugcugcggcgcgagcggcuccaccgcauccuggacauccugggcuuccucccguuccacuucgcccaggaccuggaccggcacgggaagaucgugaagggcaaggagcccaagcuggccuggcgcaagaacgaggcggggcaguucgaguucaucuuccaggacagcuucaaggagaugcucgaggacuucaagcugaaccaccccaaccugaucaccgacgacaagaagguccccuacgacuggaccaucuacuaccuccggaagaagggccugaccuccaagaucagcaaggaggagcuggccuggauccuccugaacuucaaccagaagcgcggcuacuaccagcugcgcggggaggaggaggaggagaacaagaacaagcucguggaguucuacgcccugaagguggucgccguggaggacuccggcgagaagaaggggaaggacaucugguacaacgugcaccuggagaacggcugggucuaccggcggacgagcaacaugccgcucgacugggugggcaagaccaaggaguucaucgugaccaccgaccuggagaaggacgggacgcccaagaaggacaaggagggcaacgucaagcgcuccuuccgggcgcccaaggaggacgacuggagccugcucaagaagaagaccgaggccgacaucgaccagacccacaagaccguggggguguacaucuacgacacgcugcugggcaaccccucccagaagauccgcgggcggcucguccgcaccaucgagcgcaaguacuacaaggaggagcugaagcagauccuggagaagcagaaggaguuccaccucgagcugcaggaccgggcccuguacgccgccugcaucgaggagcucuacccgaucaacgaggcgcaccgcaacaacgugggcaaccgggacuucaccuaccuguuccuggaggacauccucuucuaccagcgcccccucaagagcaagaagucccugaucgacaacugccccuacgaggagaaccagggccucgacaaggagaccggggagaucaagagcuuccccgugaagugcaucgccaagucccacccgcuguuccaggaguuccggcuguggcaguucaucgucaaccuccgcaucuaccggaaggaccuggcccaggacguggacgugacgaacgagcugcucaagaccgaggaggacuacgucgcccuguucgacuggcugaacggcaagaaggagaucgaccagaaggccuuccugaaguaccccguguucgggcucaagaaggagaucgagaacuaccgcuggaacuacguccaggacaagcccuaccccugcaacgagacccggagccugaugcuggcgcgccucgagaagugcgacaucagcaucgaguuccugaccaaggagaacgaggaggcccuguggcacauccucuacuccguggaggacaagaacgagaucgugaaggcccugcagaaguucgccgacaagcacgaccugaacgccagcuucgucgacguguuccagaaguucccgcccuucaagaaggaguacggcuccuacagcgcgaaggccaucaagaagcuccugccccugaugcggauggggaaguacugguccgagaacagcaucgacaagggcacgcgcgagcggaucgacaagaucaucaccggcgaguacgacgagaagaucgagaaccgcgugcgggagaaggccauccaccucgccgacgucuccgacuucaaggggcugccccuguggcucgugugcuacaucguguacggccgccacagcgaggccaaggagaucacccaguggaaguccccggcggacaucgacagcuaccugcgguccuucaagcagcacagccugcgcaaccccaucgucgagcagaucaucaucgagacccuccggguggugcgcgacaucuggaagcaggucgggaacaucgacgagauccacguggagcugggccgcgagaugaagaaccccgccgacaagcggaagaagaugacgcagcagauguccgagaacgagaacaccaaccugcgcaucaaguaccuccugaccgaguuccugaaccccgaguacgagguggagaacguccggccguacagccccucccagcaggacauccuccgcaucuacgaggagggggugcugaacagcguguccgaccugcccgaggagaucagcgacauccucaagaaguucaccgagacggaccugaagaagcggcccucccgcagcgagauccugcgguacaagcucuggcuggagcagaaguaccgcagcccguacaccggcgaggucaucccccugggcaagcuguucacccccgccuacgagaucgagcacgugaucccgcaguccugcuacuucgacgacagcuucuccaacaaggugaucugcgaggccgaggucaacaagcucaagagcaaccugcuggggcacgaguucaucgugaagcaccacggcgagaucguggagcugcccuucgggaagaagguccggaucuucaccguggacgaguacgagcaguucgugaaggacaacuacucccgcacgcggagcaagaugaagaagcugcucauggacgacauccccgaggaguucgucacccgccagcugaacgacucccgguacaucagcaagguggugaagucccugcucagcaacaucguccgcgagaagggcgaggaggaggcgaucuccaagaacgugauccccugcaccggcggggugaccgaccggcugaagaaggacuggggcaucaacgaggucuggaacaagaucauccugccgcgcuuccagcggcucaacgagcugacggggaccaacaaguucaccaccaagaacgugggcauccaggagauccccaccaugccccuggagcuccagaagggguucaacaagaagcgcaucgaccaccggcaccacgccauggacgccaucaucaucgccugcgccaaccgcaacaucaucaacuaccugaacaacgagagcgcgacggccaaggccgagcugucccgguacgaccuccagaagaugcugugcgacaaggccaagaccgacaacaacggcaacuacaagugggugauccgcaagcccugggccagcuucacccaggacaccuaccuggcgcucgagaacaucaucgucuccuucaagcagaaccugcgcgugaucaacaaggccacgaaccgguuccugcacuacaacgaggagggcaagaagaucuucgugaagcaggggaagggcgacaacugggccauccgcaagagcaugcacaaggacaccgucuucggggaggugaaccuccggcgcaucaagaccguggcccugaacgaggccaugaagaacccgcaguccaucgucgugaaggacuucaagcggaagcugcucgagcuguggaaccugggcuucgacgcgaagcgcaucaagaaguacuucgaggacaaccgggagaccuggagcgacaucaaccucagcaagaucgagguguacuacuucuccaaggacacgaaggaccgcuucuucgccacccggaagccccuggacaccagcuucgaccgcaagaagaucgagaacaacaucaccgacacggggauccagaagauccugcuccggcaccuggagcugaaggacaacaaccccgacaucgccuucucccccgacggcaucgacgagaugaaccgcaacaucauccagcucaacaacggcaaguaccaccagccgaucaucaagauccggugguacgagcaggccgacaaguucgcggucgggcagaccggcaacaaguucagcaaguucguggaggccgccaaggggaccaaccuguucuucgccguguacgaguccaacauccuggacaagaagaccaacacgaucaucaagaagcgcaacuacgccaccaucccccucaacgucgcgaucgagcggcagaagcagggccugcccguggcccccgaggacgagaacgggaacgacccgaucuucgugcugagccccaacgaccucgucuaccugcccaccgacgacgagcuggccaacggcaucaucgcccagccccucgaccgcggccggaucuacaagaugguguccugcaccgggaacgagggccacuucaucccggcccgcaucgcgaaccccauccugcagacgaucgagcuggggagcaacaacaaggcccagaaggccuggaccgacgagaugaucaaggagaucugcaugcccaucaaggucgaccggcucggcaacgugcuggaguccagcuccagcuacaagaaguga

SEQ ID NO: 2261 - RNA, 4521 nt, Artificial Sequence
  Cas9 variant
augaagaccauccugggccucgaccuggggcccaacagcaucggcugggccaagguggaggucgacgacgaggggaacuaccugcgcaacaucaagcucggcucccggaucaucccgaugacccaggacaugcugggggacuucgacaagggcgugaaggugagccagacggccauccgcaccgacuuccggggcaaccgccggcugaucgagcgccaccuccugcggcgcgagcggcugcaccgcguccuccacgcgcugaaguuccugcccaagcacuacgaggacgccaucgggugggaccggaacgagcccgccaccuacggcaaguucgugaacaacuccgagcccaagcucgccugggagcgccaggaggacgggagcaugcgguuccuguucauggaguccuucaacgagaugguggccgacuucgcgcagaaccagccgagccuggucuccgacggcaagaagaucccccucgacuggaccaucuacuaccugcgcaagaaggcccugacgcggcccaucaagaaggaggagcucgccuggauccugcugaacuucaaccagaagcgcggguacuaccagcuccggggcgaggaggaggaggacaaccugaccaagcgcaaggaguacuacaagcugaagguggugggcgucgaggccgacggggcgcccaagggcgggaagaccugguacaacauccaccucgagaacggcuggaccgcccggugccagagcaagaucccgcuggacgacugggugggcaaggugaaggaguacaucgucacgaccgaguacgaggacgacgggaagacccccaagugcgacaaggagggcaaggugaagcgcuccuucaagagccccgagaaggacgacuggcagcugaucaagacccggacggagaaguucaucgacgacuccaacaagaccgugggggccuucaucuacgacuaccuccuggagaagcccuucgacaagauccgcggcaaguacauccgcaccaucgagcggaaguacuacaagaacgagcugcgcgagauccuccgggagcagaccaaguaccacgaggggcugcacagccuggaggcccucaagaucugcgccgaggagcuguacaagaacaaccagcagcaccaggaguaccugcucaagaaggacaugacguuccugcugcucaacgaccugaucuucuaccagcgcccgcugaaguccaagaagucccucaucgcggacugccccuacgaggucuacaaguacgacgacaagcugaccggcaagaagggccagaagaagaucaagugcaucgccaagagcaaccccuacuaccaggaguuccggcuguggcaguucaucgccaaccuccgccuguucagcgugaccgacgggaaggaggugaccgccgaguaccugaagacggaggaggacuacguccgccucuucuccuuccugaacgaccggaaggacaucaagcaggagaccuuccugcggagcuuccugaagcucaagaaggaguccaucggcagcgagaagaucuaccccauccgcuggaacuacaucgaggacgccaacaagagcuacccgugcaacgcgacccggcacgagcugcugcucgccuucgaccgcgccgacaucccccgggagcugcuggacguggaggagcgcgaguaccggcucuggcaccuccuguacuccaucgaggccaaggaggagaccgagagcgcccuccgcaagcugaaggcgaacaaggccuucggggaccugaacaucgacgacgccuucgugaacuccuuccucaagaucaagcccuucgagaaggaguacggcgccuacagcgagaaggccaucaagaagcugcuggcggucaugcggcgcgggucccucuggaaggaggccgacaucugcgaggccacgaagcagaacaucgccaagauccugcagaacgacaucgacgagaagcugaagaagaagaucgaggcggccgugagcuccuucaacaagcucagcgacuuccagggccugcccaccuggcuggccugcuacguggucuacggccggcacuccgaggccgcccagauccagugcuggcagagcccggaggaccucaagaccuacaucaacaaguucaagcagcacucccugcgcaaccccaucguggagcagugccugcucgagacccugcgcacggucuacgacaucuggaaggacgcggggcagaucgacgagauccacaucgagcugggccggaacaugaaguccaccgccgagcagcgcgcccggaagaccaaggacauccuccgcaacgagaacaccaaccugcggaucaagaaccugcucguggagcugaagaacgacgacaagaucgagaacgugcgccccuacagccccagccagcaggagauccugcggaucuacgaggagggggcccuccaggagcuguccaaggaggacgagauguucgaggacaucagcaagaucuccaagauggcccagccgagccccacggagcugucccgcuacaagcucuggcuggagcagaaguaccggagccccuacaccggccgcgucaucccccugagcaagcuguucaccaccgcguaccagaucgagcacaucaucccgcagucccgguacuucgacgacagcuucaacaacaaggugaucugcgaguccgaggugaacagccugaaggacaacaugcugggguacgaguucaucaaggagugcggcggccgcaucguccacugcacgcuccugggggacgugaagaucuucaccaaggaggaguacaaggacuucgugaccaagcacuacaucgacaacaccuacaagcgggacaagcugcuccuggaggacaucccccaggaguucuccgcccgccagcugaacgacagccgguacaucuccaagaugguccagaccgugcucagcaacaucgugcgcgccgagaacgagcaggaggccacguccaaguucgucgugagcugcaacggcgccaucaccaaccggcugaagaaggacugggggcugaacgacgugugguccagcaucgucugcccccgcuucaagcggcucaacgagaucaccaagaccaacgcguucggccacugggaggacaaggccggcaagcacguguuccagacgaccgugccgcuggagcugcagcgcggguucuccaagaagcggaucgaccaccgccaccacgccauggacgcccucgucaucgcgugcgccagccgcaacaucgugaacuaccugaacaacgaguccgccaacagccccgagaagcgggaggaccugcgcaagaagcucugcgacgagaagcggaagauccgcaagcccuggaagaccuucacccaggacgcccgggaggcccuguccgacguggucgugagcuucaagaacuacgugcgcgucaucaacaaggcgacgaacuacuacgagcacuacagcuccagcggcaacaaggugaugaucucccagaaggggaacgacaugugggccauccggaagccccugcacaaggagagcguguucggccgcgucaaccucugccggaaggugaucgugucccugaagaaggcccuggagaacaucccggccaucugcgacaagacccuccgcgacuacaucaacgcccuggucgagaagcacuucaacacccggcagcugcucgcgcacuucaagagcaucaacuaccgccugaaccggcagugcguggagaagguggaggucuggcaguucuccgacgagaagaucgagaugguggcccgccgcaagagccuggacaccuccuucgacgacaagcagaucagcuccaucacggacaccgggauccagaagauccuccugaacuaccugcagaccaaggacggcaacgccgagaucgccuucacccccgagggcaucgaggagaugaacaagaacaucagccucuacaacgacgggaaggcccaccagcccauccugaaggugcgggucgcgacgcccaagggcaugaaguacccgguggggcagaccggcaacaaggccaccaaguucguggucgccgagaaggggaccaaccuguacuucgccaucuacgagaacgagcucggcgugcgguccuacgacacgaucccccugaacaucguggucgagcgccugaaggagggccucagccccgugccccaggcgaacgaggccgacaucccgcugaaguucuaccugucccccaacgaccucguguacguccccaccaaggagaacgaggacgagcugugccgggaccgcaucuacaaguucguggacagcuccgggaccaccgccaacuucgugccccacacgagcgccaacaccaucuacaacgucgacaaggaguacgccgagaagugcugcaacggcgcgguguuccugaacgaguacgggcucggcuccccgcagagcaagaaccagcgcgcccugaccggggagaugaucaaggagaucugcuggaagcugaagguggaccggcucggcaacaucaucaaggucaucaaguga

SEQ ID NO: 2262 - RNA, 4530 nt, Artificial Sequence
  Cas9 variant
augaagaacaucgugggccuggaccucgggaccaacagcaucggcugggccgucgugaacggguccgugaacgacgacggcagcgagcagcuggucaagauccaggccuccgggagccgcaucauccccauggacgcggccaugaucggcgacuucaacaagggcaacuccaucagccagaccgccgagcggacgcgccugcgcggggugcggcggcucuccgagcgcuaccugcugcggcgcgagcggcuccaccgcauccuggacauccugggcuuccucccguuccacuucgcccaggaccuggaccggcacgggaagaucgugaagggcaaggagcccaagcuggccuggcgcaagaacgaggcggggcaguucgaguucaucuuccaggacagcuucaaggagaugcucgaggacuucaagcugaaccaccccaaccugaucaccgacgacaagaagguccccuacgacuggaccaucuacuaccuccggaagaagggccugaccuccaagaucagcaaggaggagcuggccuggauccuccugaacuucaaccagaagcgcggcuacuaccagcugcgcggggaggaggagaagaagaacgacaacgugaugaucaucaacuccaaggugaucgacgucgugaaggccgagaaggacaagaaguacgagaaguacugguacaacgugcuccuggagaacggccugcucuaccgggccgcguucuacaacgacaucagcuucuggaaggggcacacgaaggaguucguccugaagaccaucaagcugaaguccggcggcaccaagcaggagcucagcuuccugccguccuucgacgagaucgagaagauggagaagaagcagaaggacaagauguacuucaagaucaagcugaagaccgaggccgacaucgaccaggcccacaagacgguggggaccuacaucuacgacacccuccugggcaaccccagccagaagauccgggggcgccuggugcggaccaucgagcgcaaguacuacaaggaggagcucaagcugauccuggacaagcagaaggaguuccaccccgagcuccaggaccgggcccuguacgccgcgugcaucgaggagcuguaccccaucaacgaggcccaccgcaacaacgucggcaaccgcgacuucacguaccucuuccuggaggacauccuguucuaccagcggccgcucaaguccaagaagucccugaucgacaacugccccuacgaggagaaccaggggcuggacaaggagaccggcgagaucaagagcuuccccgugaagugcaucgccaagagccacccccucuuccaggaguuccgccuguggcaguucaucgugaaccugcggaucuaccgcaaggaccucgcccaggacgucgacgugaccaacgagcugcugaagaccgaggaggacuacguggcccuguucgacuggcucaacggcaagaaggagaucgaccagaaggcguuccugaaguacccggucuucgggcugaagaaggagaucgagaacuaccgguggaacuacgugcaggacaagcccuaccccugcaacgagacgcgccuccugaugcuggcccggcucgagaagugcgacaucagcaucgaguuccugaccaaggagaacgaggaggcccuguggcacauccucuacuccguggaggacaagaacgagaucgucaaggcccugcagaaguucgccgacaagcacgaccugaacgcgagcuucguggacgucuuccgcaaguucccgcccuucaagaaggaguacggcuccuacagcgccaaggccaucaagaagcuccugccccugaugcggauggggaaguacugguccgaggacagcaucgacaagggcacccgcaagcggauggacaagaucaucaccggggaguacgacgagaagaucgagaaccgcgugcgggagaaggugauccaccucgccgacgucuccgacuuccgcggccugccccuguggcucgugugcuacaucguguacggccggcacagcgaggccaaggagaucacgcaguggaagucccccgcggacaucgacagcuaccugaaguccuucaagcagcacagccugcgcaacccgaucgucgagcagaucaucaucgagacccuccggguggugcgcgacaucuggaagcaggucgggaacaucgacgagauccacguggagcugggccgggagaugaagaaccccgccgacaagcgcaagaagaugacccagcagauguccgagaacgagaacaccaaccugcgcaucaaguaccuccugacggaguuccugaaccccgaguacgagguggagaacguccggcccuacagcccgucccagcaggacauccuccgcaucuacgaggagggggugcugaacagcguguccgaccugcccgaggagaucagcgacauccucaagaaguucaccgagaccgaccugaagaagcggcccucccgcagcgagauccugcgguacaagcucuggcuggagcagaaguaccgcagccccuacaccggcgaggucaucccgcuggggaagcuguucacgcccgccuacgagaucgagcacgugaucccccaguccugcuacuucgacgacagcuucuccaacaaggugaucugcgaggccgaggucaacaagcucaagagcaaccugcucggccacgaguucaucgugaagcaccacggcgagaucguggagcugccguucgggaagaagguccggaucuucaccguggacgaguacgagcaguucgugaaggacaacuacucccgcacccggggcaagaugaagaagcugcucauggacgacauccccgaggaguucgucgcgcgccagcugaacgacagccgguacaucuccaagguggucaagagccugcucuccaacaucgugcgcgagaagggggaggaggaggccaucagcaagaacgugauccccugcaccggcggcgugacggaccggcugaagaaggacugggggaucaacgaggucuggaacaagaucauccugccccgcuuccagcggcucaacgagcugaccggcaccaacaaguucaccacgaagaacguggggauccaggagaucccgaccaugccccuggagcuccagaagggcuucaacaagaagcgcaucgaccaccggcaccacgccauggacgccaucaucaucgccugcgcgaaccgcaacaucaucaacuaccugaacaacgaguccgccaccgccaaggccgagcugagccgguacgaccuccagaagcugcugugcgacaaggccaagaccgacaacaacgggaacuacaagugggugauccgcaagcccugggcguccuucacccaggacacguaccucgcccuggagaacaucaucgucagcuucaagcagaaccugcgggugaucaacaaggccaccaaccgcuuccuccacuacaacgaggagggcaagaagaucuucgugaagcagggcaagggggacaacugggccauccgcaaguccaugcacaaggacaccgucuucggcgaggugaaccugcggcgcaucaagaccguggcccugaacgaggcgaugaagaacccccagagcaucgucgugaaggacuucaagcggaagcuccuggagcuguggaaccucggguucgacgccaagcgcaucaagaaguacuucgaggacaaccgggagacgugguccgacaucaaccugagcaagaucgagguguacuacuucagcaaggacaccaaggaccgcuucuucgccacccggaagccgcuggacaccuccuucgaccgcaagaagaucgagaacaacaucacggacaccggcauccagaagauccuccugcggcaccuggagcucaaggacaacaaccccgacaucgccuucagccccgacgggaucgacgagaugaaccgcaacaucauccagcugaacaacggcaaguaccaccagcccaucaucaagauccggugguacgagcaggcggacaaguucgccgucggccagaccgggaacaaguucuccaaguucguggaggccgccaagggcaccaaccuguucuucgccguguacgagagcaacauccucgacaagaagacgaacaccaucaucaagaagcgcaacuacgcgaccaucccgcugaacgucgccaucgagcggcagaagcaggggcugcccguggcccccgaggacgagaacggcaacgaccccaucuucgugcucuccccgaacgaccuggucuaccugcccaccgacgacgagcucgccaacgggaucaucgcccagccccuggaccgcggccggaucuacaagauggugagcugcacgggcaacgaggggcacuucauccccgcgcgcaucgccaacccgauccugcagaccaucgagcucggcuccaacaacaaggcccagaaggccuggaccgacgagaugaucaaggagaucugcaugcccaucaagguggaccggcuggggaacguccuggagagcuccagcuccuacaagaaguga

SEQ ID NO: 2263 - RNA, 4530 nt, Artificial Sequence
  Cas9 variant
augaagcgcauccugggccucgaccuggggaccaacagcaucggcuggucccugaucgagcacgacuucaagaacaagcaggggcagaucgagggccucggggugcggaucauccccaugagccaggagauccugggcaaguucgacgccggccaguccaucagccagaccgccgaccgcacgaaguaccgcgggguccggcggcuguaccagcgcgacaaccuccggcgcgagcggcugcaccgcgugcugaagauccucgacuuccugccgaagcacuacuccgagagcaucgacuuccaggacaaggugggccaguucaagcccaagcaggaggucaagcugaacuaccggaagaacgagaagaacaagcacgaguucguguucaugaacuccuucaucgagauggugagcgaguucaagaacgcgcagcccgagcuguucuacaacaaggggaacggcgaggagaccaagauccccuacgacuggacccuguacuaccugcgcaagaaggcccucacccagcagaucacgaaggaggagcuggccuggcugauccucaacuucaaccagaagcggggguacuaccagcugcgcggcgaggacaucgacgaggacaagaacaagaaguacaugcagcugaaggucaacaaccucaucgacuccggcgccaaggugaaggggaaggugcuguacaacgucaucuucgacaacggcuggaaguacgagaagcagaucgugaacaaggacgagugggaggggcggaccaaggaguucaucaucaccaccaagacgcugaagaacggcaacaucaagcgcaccuacaaggccguggacagcgagaucgacugggcggccaucaaggccaagaccgagcaggacaucaacaaggccaacaagaccgucggcgaguacaucuacgagucccuccuggacaacccgagccagaagauccgggggaagcuggugaagacgaucgagcgcaaguucuacaaggaggaguucgagaagcuccuguccaagcagaucgagcugcagcccgagcuguucaacgagagccucuacaaggcgugcaucaaggagcuguacccccggaacgagaaccaccaguccaacaacaagaagcagggcuucgaguaccucuucaccgaggacaucaucuucuaccagcgcccccucaagagccagaaguccaacaucagcgggugccaguucgagcacaagaucuacaagcagaagaacaagaagaccggcaagcuggagcucaucaaggagccgaucaagaccaucucccggagccacccccuguuccaggaguuccgcaucuggcaguggcugcagaaccucaagaucuacaacaaggagaagaucgagaacgggaagcuggaggacgugacgacccagcugcuccccaacaacgaggccuacgucacccuguucgacuuccugaacaccaagaaggagcucgagcagaagcaguucaucgaguacuucgugaagaagaagcugaucgacaagaaggagaaggagcacuuccgcuggaacuucguggaggacaagaaguaccccuucagcgagacgcgggcccaguuccugucccgccucgccaaggucaagggcaucaagaacaccgaggacuuccugaacaagaacacccaggugggcagcaaggagaacuccccguucaucaagcggaucgagcagcuguggcacaucaucuacagcguguccgaccugaaggaguacgagaaggcccucgagaaguucgcggagaagcacaaccuggagaaggacagcuuccugaagaacuucaagaaguucccgcccuucgucuccgacuacgccagcuacuccaagaaggccaucagcaagcuccugcccaucaugcgcauggggaaguacugguccgagagcgccgugcccacccaggugaaggagcggucccugagcaucauggagcgcgucaaggugcucccccugaaggagggcuacuccgacaaggaccuggccgaccuccugagccgggucuccgacgacgacauccccaagcagcugaucaagagcuucaucuccuucaaggacaagaacccccucaaggggcugaacacguaccaggcgaacuaccugguguacggccgccacagcgagaccggggacauccagcacuggaagaccccggaggacaucgaccgguaccucaacaacuucaagcagcacagccugcgcaaccccaucguggagcaggucgugauggagacccugcgggugguccgcgacaucugggagcacuacggcaacaacgagaaggacuucuucaaggagauccacguggagcucggccgggagaugaagucccccgccgggaagcgcgagaagcugagccagcggaacacggagaacgagaacaccaaccaccgcauccgggaggugcugaaggagcucaugaacgacgccuccgucgagggcggggugcgcgacuacagccccucccagcaggagauccugaagcuguacgaggagggcaucuaccagaacccgaacaccaacuaccucaagguggacgaggacgagauccugaagauccggaagaagaacaaccccacccagaaggagauccagcgcuacaagcuguggcucgagcagggguacaucagccccuacacgggcaagaucaucccccugaccaagcuguucacccacgaguaccagaucgagcacaucaucccgcagucccgcuacuacgacaacagccucggcaacaagaucaucugcgaguccgaggucaacgaggacaaggacaacaagaccgccuacgaguaccugaagguggagaaggggagcaucguguucggccacaagcugcucaaccuggacgaguacgaggcccacgucaacaaguacuucaagaagaacaagacgaagcugaagaaccuccuguccgaggacauccccgagggguucaucaaccggcagcugaacgacagccgcuacaucuccaagcucgugaagggccugcugagcaacaucgugcgggagaacggcgagcaggaggcgaccuccaagaaccucauccccgucaccgggguggugaccagcaagcugaagcaggacuggggccugaacgacaaguggaacgagaucaucgccccgcgcuucaagcggcucaacaagcugaccaacuccaacgacuucggguucugggacaacgacaucaacgccuuccgcauccagguccccgacagccugaucaagggcuucagcaagaagcggaucgaccaccgccaccacgcccucgacgcccuggugguggcgugcacgucccggaaccacacccacuaccugagcgcccucaacgccgagaacaagaacuacucccugcgcgacaagcuggucaucaagaacgagaacggggacuacaccaagaccuuccagauccccuggcagggcuucacgaucgaggccaagaacaaccucgagaagaccguggugagcuucaagaagaaccugcgggucaucaacaagaccaacaacaaguucugguccuacaaggacgagaacggcaaccugaaccucgggaaggacggcaagcccaagaagaagcugcgcaagcagaccaagggguacaacugggcgauccggaagccgcugcacaaggagacggugagcggcaucuacaacaucaacgcccccaagaacaagaucgccaccuccgugcgcacccuccugaccgagaucaagaacgagaagcaccuggccaagaucacggaccuccggauccgcgagaccauccugcccaaccaccugaagcacuaccucaacaacaagggggaggccaacuucagcgaggcguucucccagggcggcaucgaggaccugaacaagaagaucaccacccugaacgaggggaagaagcaccagcccaucuaccgggucaagaucuucgaggugggcagcaaguucuccaucagcgaggacgagaacuccgccaagagcaagaaguacguggaggccgccaaggggacgaaccucuucuucgccaucuaccuggacgaggagaacaagaagcgcaacuacgagaccaucccgcugaacgaggucaucacccaccagaagcaggucgcgggcuuccccaaguccgagcggcucagcgugcagcccgacucccagaaggggaccuuccuguucacgcugagccccaacgaccucguguacgugccgaacaacgaggagcuggagaaccgcgaccuguucaaccucggcaaccugaacguggagcagaucucccggaucuacaaguucaccgacagcagcgacaagaccugcaacuucauccccuuccaggucuccaagcugaucuucaaccucaagaagaaggagcagaagaagcuggacguggacuucaucauccagaacgaguucggccuggggagcccccaguccaagaaccagaaguccaucgacgacgugaugaucaaggagaagugcaucaagcucaagaucgaccgccugggcaacaucagcaaggccuga

SEQ ID NO: 2264 - RNA, 4530 nt, Artificial Sequence
  Cas9 variant
augaagaccauccugggccucgaccuggggaccaacagcgugggcugggccgucaucaacuccgugaucaaggagcaggccgagcgcaucuggaucgagauggcggggagccggaucauccccauggacgccgccgugcugggcgacuucgacaaggggaacuccaucagccagacguccgagcgcacccggcuccgcggcguccggcgccugcgggagcgccagcugcuccggcgcgagcggcugcacaaggugcugaacauccucggcuuccugccgaaccacuaccuggaguacaucgacuucgagaagcaccccgggaaguuccucagcgacgccgagcccaagcugcccugggugaaggacgagcagggcaaguacaccuuccuguuccaggccgcguucgacgagaugcucgccgacuucgccauccaccagccgucccuggucagcggggacaagaagauccccuacgacuggaccaucuacuaccugcgcaagaaggcccucacggagaugaucuccaaggaggagcuggcguggauccugcucaacuucaaccagaagcggggcuacuaccagcugcgcggggaggaggaggaggacaacgccggcaagagcguggaguucuacgcccugaaggugcucaccgucgaggccaccgacgagaagaagggccgggacgugugguacaacgugcaccuggagaacggguggaucuaccgccgguccagcuccgucccccuggacugggagggccagaucaaggaguucaucgugaccacggaccucaaccccgacagcaccccgaagcuggacaaguacggggaggugaagcgcuccuuccgggcccccaaggaggacgacuggaugcugaucaagaagcgcaccgaggcggacaucgccaacacccacaagacggucggcgccuacaucuacgacacccuccugcagaagccccagcagaagaucaucggcaagcuggugaagaccguggagcggaagcucuaccgcgacgagcugagccugauccuccagaagcagugcgccuuccacgccgagcugcaggaccgcacccuguacgcgcggugcgucgaggcccucuaccccaacaacgaggugcagcgccggaacaucgccaaccgcgacuucguguaccugcugauggacgacguccucuucuaccagcggccgcugaagacgaagaagucccugaucgccaacugccccuacgaggagaacgaguacguggaccgcgagaccggggagaucaagaaggcgccccucaagugcaucgccaagagccacccccuguuccaggaguuccggcuguggaacuuccucuccaacauccgcaucuaccagaaggagaaggagaucaacggcacccugcaccuggacguggacgucaccgccgaguuccugaagacggaggacgacuacguggcccucuucgacuggcugaacagccggaaggagaucgagcagaagaccuuccugaaguacccgaaguucgggcucaagaaggagaucagcaacuaccgcuggaacuacgucgaggacaagcaguaccccugcaacgagacccggcacgccauccugucccgccuggagaaggccaacgugugcaucgacuuccucagcaacgagaaggagguggcgcuguggcacauccuguacuccgucagcgacaagcaggagaucgagaaggcccuccggaccuucgccgccaagaacggccuggacgaguccuucguggaggcguucaagaaguucccgcccuucaagagcgaguacggggccuacuccgccaaggccaucaagaagcugcucccccugaugcgcugcggcaaguacugggacgugagcuccaucgacgacacgaccaaggagcggaucaagaagaucgucgccggcgaguacgacgagcgcaucgcggugaaggugcgggacaaggucaugaaccugagcgacaucuccugcuucaagcgccucccccuguggcuggccugcuacaucguguacaaccggcacagcgaggacaaggaggccgugaagugggagucccccgccgacaucgacgccuaccucgcgagcuucaagcagcacucccugcgcaaccccaucgucgagcaggucaucaccgagacccugcgcguggugcgggacaucuggaagcaggucgggcgcaucgacgagauccacaucgagcucggccgggagaugaagaacccggccgacaagcgcaagcggaugacggcccagauccuggagaacgagaacgccaaccugcgcaucaaggcccuccuggcggaguucaugaaccccgaguacgagaucgagaacgugcggcccuacagccccucccagcaggagauccugcgcaucuacgaggacauggugcuccacgccgaggaccagcugccggaggagaucgacgccauccugaagaaguucaacagcuccaaggugcccaccaagagcgaguuccuccgguacaagcuguggcuggagcagaaguaccgcagccccuacaccggggagcucaucccgcugggcaagcuguucaccgccgcguacgagaucgagcacgugaucccccagucccgguacuucgacgacagcuucuccaacaaggucaucugcgagagcgccgugaacaagcucaaggacaaccagcugggguacgaguucaucaagaaccaccacggccagaagguggaggucggcuucgggaaguccguggagaucuucagcguggacuccuacgagcgcuucgucaaggagcaguacgccaagagcgccgugaagaugaagaagaugcugauggacgacauccccgagcaguucaucgagcggcagcucaacgacucccgcuacaucagcaaggugaucaagggccugcuguccaacaucguccgggagaagaacgacagcggggaguacgagcccgaggccguguccaagaacaucguggucugcacgggcagcgugaccgaccgccucaagcgggacugggggaugaacgacguguggaacuccaucgucuacccgcgcuucgagcggcugaacagccugaccgacacccaguccuucggccacugggagaacaagagcggcaagaagguguuccagacggagcucccccuggaguaccagaagggguucagcaagaagcgcaucgaccaccggcaccacgcgauggacgccaucgugaucgccugcgccacccgcaaccacgucaacuaccuguccaacgagagcgccucccgcaacgcgaagaucagccgguacgaccuccagcgccugcugugcgacaagucccggaccgacgacaacggcaacuacaagugggugaucaagaagcccugggacaccuucacccaggacgcccgcgaggugcucagcaagaucgucgugucccugaagcagaaccugcggaucaucaacaagacgaccaacguguaccgccaccucgacgccaccgggaaccgggucuacgagaagcagaagaccggcgacagcugggccauccgcaagcccaugcacaaggacacgguguucggcgccgugaaccugcggaaggucaagguggugcgccuguccgucgcgcucgacgccccgaccaugaucguggacaagcgggucaagaacaagguguucgagcugcugagcuacaaguacgacaagaagcgcaucgagaaguacuucaaggagaacgccgugcucuggaaggagcuggaccuggcccgggucgcgguguacuacuucaccgaggccaccacggagccccucguggccguccgcaagccccuggacuccaccuucaacgagaagaagaucaaggagagcgugaccgacaccgggauccagaagauccugcucaaccaccugugcacgaaggagggcaagcccgaccuggccuucuccgccgaggggaucgaggagaugaaccggaaccuccugcagcugaacaacggcaagcgccaccagccgaucuacaaggugcgggucuacgagccccgcgggaacaaguucagcgugggcgugcucggcaacaaggggaccaagugggucgaggcggccaagggcaccaaccuguucuucgccaucuacaucaccgaggacgggaagcggacguacgagaccaucccccugaacauggugaucgagcgcgagaagcagggccucgcccccgugccggacaagaacgagaagggggacaagcugcuguucuggcucucccccaacgaccuggucuaccugcccaccgaggaggagcucgaguucggccgcaucaacgagcccaucgaccggggccgcaucuacaagauggugagcuccagcgggaaccagugcuucuucaucccgcaguccaucagcaacgccaucauccccaccaaggagcugggcgcgaacaacaaggccgagcggagcugggacggggccaugaucaagaacaucugcauccccgugaaggucgaccgccugggccggaucaucgaggugaaguaccgcaucaacgaguga

SEQ ID NO: 2265 - RNA, 4530 nt, Artificial Sequence
  Cas9 variant
augaagaccauccugggccucgaccuggggaccaacagcgugggcugggccgucaucaacuccgugaucaaggagcaggccgagcgcaucuggaucgagauggcggggagccggaucauccccauggacgccgccgugcugggcgacuucgacaaggggaacuccaucagccagacguccgagcgcacccggcuccgcggcgcccggcgccugcgggagcgccagcugcuccggcgcgagcggcugcacaagguccugaacauccucggcuuccugccgaaccacuaccuggaguacaucgacuucgagaagcaccccgggaaguuccucgccgacgcggagcccaagcuggccugggugaaggacgagcagggcaaguacaccuuccuguuccaggccgccuucgacgagaugcucgcggacuucgccauccaccagcccagccugguguccggggacaagaagaucccguacgacuggaccaucuacuaccugcgcaagaaggcccucacggagaugaucagcaaggaggagcuggccuggauccugcucaacuucaaccagaagcggggcuacuaccagcugcgcggggaggaggaggaggacaacgccggcaaguccgucgaguucuacgcgcugaaggugcucaccguggaggccaccgacgagaagaagggccgggacgucugguacaacgugcaccuggagaacggguggaucuaccgccggagcuccagcgugccccuggacugggagggccaggucaaggaguucaucgugaccacggaccucaaccccgacgggacccccaagcuggacaaguacggcgaggugaagcgcuccuuccgggccccgaaggaggacgacuggaugcugaucaagaagcgcaccgaggccgacaucgccaacacccacaagacggucggcgcguacaucuacgacacccuccugcagaagccccagcagaagaucaucgggaagcuggugaagaccguggagcggaagcucuaccgcgacgagcugagccugauccuccagaagcagugcgccuuccacgccgagcugcaggaccgcgcccuguacgcccggugcgucgaggcgcucuaccccuccaacgaggugcgccggaagaacaucgccaaccgcgacuucguguaccugcugauggacgacauccucuucuaccagcggccccugaagaccaagaagucccugaucgccaacugcccguacgaggagaacgaguacgucgaccgcgagacgggcgagaucaagaagacgccccucaagugcaucgccaagagccacccccuguuccaggaguuccggcuguggaacuuccucagcaacauccgcaucuaccagaaggagaaggagaucaacgggacccugcaccuggacguggacgugaccgccgaguuccugaagaccgaggacgacuacgucgcccucuucgacuggcugaacucccggaaggagaucgagcagaagaccuuccugaaguaccccaaguucggccucaagaaggagaucagcaacuaccgcuggaacuacguggaggacaagcaguacccgugcaacgagacccggcacgcgauccugagcucccuggagaaggccaacgucugcaucgacuuccucagcaacgagaaggagguggcccuguggcacauccuguacuccgugagcgacaagcaggagaucgagaaggcgcuccgcaccuucgccgccaagaacgggcuggacgaguccuucgucgaggccuucaagaaguucccgcccuucaagagcgaguacggcgccuacuccgcgaaggccaucaagaagaugcugccccucaugcggugcggcaaguacugggacgugagcuccaucgacgacacgaccaaggagcgcaucaagaagaucgugaccggggaguacgacgagcggaucagcgucaaggugcgcgacaaggugaugaaccuguccgacaucagcugcuuccggcgccugccccucuggcuggccugcuacaucgucuacaaccggcacuccgaggacaaggaggccgugaagugggagagccccgccgacaucgacgcguaccuggccuccuucaagcagcacagccuccgcaaccccaucguggagcaggucaucaccgagacgcugcgcguggugcgggacaucuggaagcaggucggccgcaucgacgagauccacaucgagcuggggcgggagaugaagaaccccgccgacaagcgcaagcggaugaccgcccagauccucgagaacgagaacgccaaccugcgcaucaaggcgcugcucgccgaguucaugaacccggaguacgagaucgagaacgugcggcccuacucccccagccagcaggagauccugcgcaucuacgaggacaccgugcugcacgccgaggaccagcuccccgaggagaucgacgccauccugaagaaguucaacuccagcaaggucccgaccaagagcgaguuccugcgguacaagcucuggcuggagcagaaguaccgcucccccuacacgggcgagcugaucccccucgggaagcuguucaccgcggccuacgagaucgagcacgugaucccgcagagccgguacuucgacgacuccuucagcaacaaggugaucugcgaguccgccgucaacaagcugaaggacaaccagcucggcuacgaguucaucaagaaccaccacggccagaagguggaggugggguucggcaagagcgucgagaucuucuccguggacagcuacgagcgcuucgugaaggagcaguacgccaaguccgccgucaagaugaagaagcugcugauggacgacauccccgagcaguucaucgagcggcagcucaacgacagccgcuacaucuccaaggugaucaaggggcugcugagcaacaucgugcgggagaagaacgacuccggcgaguacgagcccgaggcggucagcaagaacaucguggugugcaccggguccgucaccgaccgccucaagcgggacuggggcaugaacgacguguggaacagcaucguguacccccgcuucgagcggcugaacucccugacggacacccagagcuucggccacugggagaacaagagcgggaagaaggucuuccagaccgagcucccgcuggaguaccagaagggcuucuccaagaagcgcaucgaccaccggcaccacgccauggacgccaucgugaucgccugcgccacccgcaaccacgugaacuaccugagcaacgaguccgcgagccgcaacgccaagaucucccgguacgaccuccagcgccugcugugcgacaagaaccggaccgacgacaacgggaacuacaagugggucaucaagaagcccugggacacguucacccaggacgcccgcgaggugcucagcaagaucguggucucccugaagcagaaccugcggaucaucaacaagaccaccaacguguaccgccaccucgacgccacgggcaaccggguguacgagaagcagaagaccggcgacagcugggccauccgcaagcccaugcacaaggacaccgucuucggggcggugaaccugcggaaggugaaggucgugcgccuguccguggcccucgacacccccgccaugaucgucgacaagcgggugaagaacaaggucuucgagcugcugagcuacaaguacgacaagaagcgcaucgagaaguacuucaaggagaacgccuuccucuggaaggagcuggaccuggcgaagguggccguguacuacuucacggaggccaccaccgagccgcucgucgccgugcggaagccccuggacuccaccuucaacgagaagaagaucaaggagagcgugacggacaccggcauccagaagauccugcucaaccaccugugcaccaaggaggggaagcccgaccuggccuucuccgcggagggcaucgaggagaugaaccgcaaccuccugcagcugaacaacggcaagagccaccagcccaucuacaagguccggguguacgagccgcgcgggaacaaguucuccgugggcguccucgggaacaagggcaccaaguggguggaggccgccaaggggacgaaccuguucuucgccaucuacaucaccgaggacggcaagcggaccuacgagaccaucccccugaacguggucaucgagcgcgagaagcaggggcucgugcccgugcccgaccggaacaagaagggcgacaagcugcuguucuggcucagcccgaacgaccuggucuaccugcccacggaggaggagcgcgaguucggccgcaucaacgagcccaucgaccgggggcgcaucuacaagaugguguccugcaccggcaacgaggggcacuucauccccgccaacguggcgaacccgaucguccccgugaucgagcucggcagcaacaacaaggcccagcgggccuggaccaacgagaugaucaaggacaucugcauccccaucaagguggaccgccuggggcacaucaucgaggucaaguaccggaucgacgaguga

SEQ ID NO: 2266 - RNA, 4530 nt, Artificial Sequence
  Cas9 variant
augaagaagauccugggccucgaccuggggaccaacagcgugggcugggccgucaucaacuccguggugaacgacgaggggaaggagcagcuggucaacaucagcuccugcggcagccgcaucauccccauggacgccgcgacccucggggacuucgacaagggcaacuccaagagcccgguggccgagcggacgcgccugcggggcgugcgccggcugcucgagcgcucccugcugcggcgcgagcggcuccaccgcguccugagcgugaugggguuccugcccgagcacuacgccgcccagcucgaccgguacggcaaguuccugcccgagaccgagcccaagcuggccugguacaaggacgagaccgggaaguaccgcuuccucuuccaggacuccuucaacgagaugcuggaggacuuccacgagcaccacccggagcugguggcggagggcaagaagauccacuacgacuggaccaucuacuaccuccggaagaaggcccugagccagaagaucacgaaggaggagcuggccuggauccuccugaacuucaaccagaagcgcggguacuaccagcugcggggcgaggaggagcaggaggacaacaagaaguccgucgaguacuacgcccucaaggugguggcggucgaggacagcggcgaccgcaaggggaaggacaucugguacaacgugaagcuggagaacggcuggguguaccggcgcgccuccggggucccccuggacugggugggcaaggugaaggaguucaucgucaccaccgaccucgacgagaagggcaaccccaagaaggacaaggacgggaacgugaagcggagcuuccgcgcccccaaggaggacgacuggggccugcugaagacccggacgcaggcccagaucgacgaguccgggcagaccgugggcaccuacaucuacgagagccuccugcgcaugccggaccagaagauccgcgggaagcugguccggaccaucgagcgcaaguacuacaaggacgagcuccggaagauccugaucaagcaguccgaguuccacacggcccugcaggaccacaaccuccugcuggcgugcaucgaggagcucuaccccaacaacgaggcccaccgccggcugcugagcaccuccgacuucaccuacuuccucguggaggacauccuguucuaccagcgcccccucaagagccagaagggccagaucgacgacugccccuacgagagccacguguaccgggacaagaaggacggcucccuccagcacgucccgcugaagugcgugagcaagucccacccccuguuccaggaguuccgccucuggcacuuccugagcuuccugcggaucuaccagcgcgagcggaugaucgacgggucccugaagcucgacgucgacgugaccaacgaguuccugcagaacgaggacgacuacgugaagcuguucgacuggcucaacgagcgcaaggagaucgaccagaagacgauccuggccuacaagcccuucggccugaagaagaacgagcagagcaaguaccgguggaacuacgucgaggacaaguccuaccccugcaacagcacccgcgccgacaugaucuuccggcucuccaaggccggggugccggaggaguuccugacccgcgagaaggaggaggcgcuguggcacauccucuacagcaucuccgacaagaaggagcugaccaaggcccugggcacguucgccgagaagaacgggcucaacgagaccuucguggagaucuucagcaagaugccgcccuucgaguccgacuacgccgccuacagccugaaggcgauccggaagcugcucgcccugaugcgcaugggcaaguacugggacgagcaggccaucgacgagcacacccggucccgcaucgagaagauccugaccggcgaguacgacgagacgauccgcacccggguccgcgagaaggccaugcaccucaccgacaucagcuccuuccgggggcugccccuguggcucgccugcuacgugguguacgaccgccacagcgaggcgaaggagcuggucaagugggagacccccgacgacaucgaccacuuccugcggaaguucaagcagcacucccuccgcaaccccaucguggagcagaucaucauggagacgcugcggaccgugcgcgacaucuggaagcaggagggcaagaucgacgagauccacgucgagcuggggcgggagaugaagaaccccgccaaggagcgcgcccggaucaccgcccaggugcucgagaacgagaacaccaaccugcgcaucaaggcgcugcucgccgaguucaugaaccccgaguucgagaucgagaacgugcggccguacagccccgcccagcaggagauccugcgcaucuacgaggagggcguccugagcgggguggccgagaaggaccuccccgacgacaucgccuccauccugaagaaguuccgggagaacgacgugaagaagcgccccacgaccagcgagguccugcgguacaagcucuggcuggagcagcgcuaccgguccccguacaccggccgcaucaucccccugggcaagcuguucacccccgcguacgagaucgagcacgugaucccgcagagccgguacuucgacgacuccuucacgaacaaggugaucugcgagagcgccgucaacaagcugaaggacaacugccugggguacgaguucgugaagaagcacuccggcgagaagguggagcucgggaacggcgagaccgccaccaucuucagcgucgaggaguacgagcgcuucgugaaggacuccuacuucaacaacagcaagaagaucaagaagcugcugcucgaggacauccccgacaacuucaucgagcgccagcugaacgacucccgguacaucagcaagguggucaagucccugcucagcaacaucgugugcgaggagggcgagcaggaggggauguccaagaacgugaucgucugcaccggcggggugaccgaccgccugaagaaggacuggggcgugcaggacgucuggaaccggaucauccugccccgcuuccuccggcugaacaagaugacggaccgcaccgacuucaccgccgugagcaccaacgggcaccuccugcccgccgugccgcugcaccuccagaagggcuucaacaagaagcggaucgaccaccgccaccacgcgauggacgccaucgucaucgccugcgccggccggaacaucgugaacuaccugaacaacgccuccgcgcgcaaggggagcgagaucagccgguacgaccugcagcaccuccugugcgacaaggugaagacggacgccaacggcaacuacaaguggauccugcgcaagcccugggagaccuucacccaggaccuguacgccgcccucaccaacaucgucguguccuucaagcagaaccugcgggugaucaaccgcacgaccaaccacuaccagcacuacaacgaggacggggagaagaagaugaucccccagaccaagggcgaccggcuggcgauccgcaagcccaugcacaaggacaccgucuacggggaggugaaccuccggaaggagaagacgcugccgcugaaggacguggucaagaaccccagcgccgugguggacaagucccucaagaacaagcuguacgagcugcucaagagccaguacgaccugaaggccaucaccaaguacuucgagacccaccaggacgucugggccgacgugaaccugaagaagaucaagguguacuacuucaccaaggagacgaacgagcgcuucuucgccacccggaagucccucgacagcuccuucagccagaagaagaucgaggaggaggucaccgacaccggcauccagaagauccugcugcgccaccuccagcagaacggcaacaaccccgacaucgcguucucccccgacgggguggagcgcaugaaccagaacaugacgauccugaacgacggcaaguggcaccagccgaucuacaagguccggaccuacgagaaggccgacaaguucgccgugggggagaagggcaacaaggugaagaaguucgucgaggccgccaaggggaccaaccuguucuucgcgguguacgagagcauccaggaggacgaggccaccggcaagcagguccgcaagcggacguucgccaccaucccccucaacgaggugaucaagcgcaagaagcagggccugcccgccgcccccgaggacuccaaggggaaccugccgaucuucgugcucagccccaacgaccugguguaccugcccaccgaggaggagcggaacuccggcaagaucauccagccccucgaccgcgagcggaucuacaagauggucagcugcaccgagggggagugccacugcaucccggaguacguggcgaaccccauccugcagacgaucgagcugggcuccaacaacaaggcccagcgcgccuggagcggggagaugaucaaggagaucugcgugcccgucaagguggaccggcucggcaacgugucccugaucaagaucuga

SEQ ID NO: 2267 - RNA, 4530 nt, Artificial Sequence
  Cas9 variant
augaagaccauccugggccucgaccuggggaccaacagcgugggcugggccgucaucaacuccgugaucaaggagcaggccgagcgcaucuggaucgagacggcggggagccggaucauccccauggacgccgccgugcugggcgacuucgacaaggggaacuccaucagccagaccuccgagcgcacccggcuccgcggcgcccggcgccugcgggagcgccagcugcuccggcgcgagcggcugcacaagguccugaacauccucggcuuccugccgaaccacuaccuggaguacaucgacuucgagaagcaccccgggaaguuccucgccgacgcggagcccaagcuggccugggugaaggacgagcagggcaaguacaccuuccuguuccaggccgccuucgacgagaugcucgcggacuucgccauccaccagcccagccugguguccggggacaagaagaucccguacgacuggacgaucuacuaccugcgcaagaaggcccucaccgagaugaucagcaaggaggagcuggccuggauccugcucaacuucaaccagaagcggggcuacuaccagcugcgcggggaggaggaggaggacaacgccggcaaguccgucgaguucuacgcgcugaaggugcucaccguggaggccaccgacgagaagaagggccgggacgucugguacaacgugcaccuggagaacggguggaucuaccgccggagcuccagcgugccccuggacugggagggccaggucaaggaguucaucgugacgaccgaccucaaccccgacgggacccccaagcuggacaaguacggcgaggugaagcgcuccuuccgggccccgaaggaggacgacuggaugcugaucaagaagcgcaccgaggccgacaucgccaacacgcacaagaccgucggcgcguacaucuacgacacccuccugcagaagccccagcagaagaucaucgggaagcuggugaagaccguggagcggaagcucuaccgcgacgagcugagccugauccuccagaagcagugcgccuuccacgccgagcugcaggaccgcgcccuguacgcccggugcgucgaggcgcucuaccccuccaacgaggugcgccggaagaacaucgccaaccgcgacuucguguaccugcugauggacgacauccucuucuaccagcggccccugaagacgaagaagucccugaucgccaacugcccguacgaggagaacgaguacgucgaccgcgagaccggcgagaucaagaaggcgccccucaagugcaucgccaagagccacccccuguuccaggaguuccggcuguggaacuuccucagcaacauccgcaucuaccagaaggagaaggagaucaacgggacccugcaccuggacguggacgugaccgcggaguuccugaagacggaggacgacuacgucgcccucuucgacuggcugaacucccggaaggagaucgagcagaagaccuuccugaaguaccccaaguucggccucaagaaggagaucagcaacuaccgcuggaacuacguggaggacaagcaguacccgugcaacgagacccggcacgccauccugagcucccuggagaaggccaacgucugcaucgacuuccucagcaacgagaaggagguggcgcuguggcacauccuguacuccgugagcgacaagcaggagaucgagaaggcccuccgcaccuucgccgccaagaacgggcuggacgaguccuucgucgaggccuucaagaaguucccgcccuucaagagcgaguacggcgcguacuccgccaaggccaucaagaagaugcugccccucaugcggugcggcaaguacugggacgugagcuccaucgacgacacgaccaaggagcgcaucaagaagaucgugaccggggaguacgacgagcggaucgccgucaaggugcgcgacaaggugaugaaccugagcgacaucuccugcuuccggcgccugccccucuggcuggccugcuacaucgucuacaaccggcacagcgaggacaaggaggcggugaagugggagucccccgccgacaucgacgccuaccuggccagcuucaagcagcacucccuccgcaaccccaucguggagcaggucaucaccgagacgcugcgcguggugcgggacaucuggaagcaggucggccgcaucgacgagauccacaucgagcuggggcgggagaugaagaaccccgccgacaagcgcaagcggaugaccgcgcagauccucgagaacgagaacgccaaccugcgcaucaaggcccugcucgccgaguucaugaacccggaguacgagaucgagaacgugcggcccuacagccccucccagcaggagauccugcgcaucuacgaggacaccgugcugcacgcggaggaccagcuccccgaggagaucgacgccauccugaagaaguucaacagcuccaaggucccgaccaagagcgaguuccugcgguacaagcucuggcuggagcagaaguaccgcagccccuacacgggcgagcugaucccccucgggaagcuguucaccgccgccuacgagaucgagcacgugaucccgcagucccgguacuucgacgacagcuucuccaacaaggugaucugcgagagcgccgucaacaagcugaaggacaaccagcucggcuacgaguucaucaagaaccaccacggccagaagguggaggugggguucggcaaguccgucgagaucuucagcguggacuccuacgagcgcuucgugaaggagcaguacgccaagagcgccgucaagaugaagaagcugcugauggacgacauccccgagcaguucaucgagcggcagcucaacgacucccgcuacaucagcaaggugaucaaggggcugcuguccaacaucgugcgggagaagaacgacagcggcgaguacgagcccgaggccgucuccaagaacaucguggugugcaccgggagcgucaccgaccgccucaagcgggacuggggcaugaacgacguguggaacuccaucguguacccccgcuucgagcggcugaacagccugacggacacccaguccuucggccacugggagaacaagagcgggaagaaggucuuccagaccgagcucccgcuggaguaccagaagggcuucagcaagaagcgcaucgaccaccggcaccacgccauggacgccaucgugaucgcgugcgccacccgcaaccacgugaacuaccuguccaacgagagcgccucccgcaacgccaagaucagccgguacgaccuccagcgccugcugugcgacaagaaccggaccgacgacaacgggaacuacaagugggucaucaagaagcccugggacacguucacccaggacgcccgcgaggugcucuccaagaucguggucagccugaagcagaaccugcggaucaucaacaagaccaccaacguguaccgccacuucgacgcgacggugaaccgggucuacgagaagcagaagaccggcgacuccugggccauccgcaagcccaugcacaaggacaccguguucggcgccgugaaccuccggaaggucaagguggugcgccugagcgucgcccuggacacccccgcgaugaucguggacaagcgggucaagaacaagguguucgagcuccuguccuacaaguacgacaagaagcgcaucgagaaguacuucaaggagaacgccuuccuguggaaggagcucgaccuggccaagguggccgucuacuacuucacggaggccaccaccgagccgcugguggcggugcggaagccccucgacagcaccuucaacgagaagaagaucaaggaguccgucacggacaccgggauccagaagauccugcugaaccaccucugcaccaaggagggcaagcccgaccuggccuucagcgccgaggggaucgaggagaugaaccgcaaccugcuccagcugaacaacggcaagucccaccagcccaucuacaaggugcggguguacgagccgcgcgggaacaaguucagcgucggcgugcugggcaacaaggggaccaaguggguggaggccgccaagggcacgaaccucuucuucgcgaucuacaucaccgaggacgggaagcggaccuacgagaccaucccccugaacgucgugaucgagcgcgagaagcagggccuggugcccguccccgaccggaacgagaagggggacaagcuccuguucuggcuguccccgaacgaccucguguaccugcccacggaggaggagcgcgaguucggccgcaucaacgagcccaucgaccggggccgcaucuacaagauggugagcugcaccgggaacgagggccacuucauccccgccaacgucgccaacccgaucgugcccgugaucgagcugggguccaacaacaaggcccagcgggccuggaccaacgagaugaucaaggacaucugcauccccaucaaggucgaccgccucggccacaucaucgaggugaaguaccggaucgacgaguga

SEQ ID NO: 2268 - RNA, 4530 nt, Artificial Sequence
  Cas9 variant
augaagaagacccugggccucgaccuggggaccaacagcaucggcugggccgugaucaacuccaacaucgacagcgaggggaaggagaagcuggucggcaucuccagcugcgggucccgcaucauccccauggacgccacgacccucggcgacuucggcaaggggaacaccaagagcccgguggcggagcggacccgccugcggggcauccgccggcugcucgagcgcucccugcugcggcgcgagcggcuccaccgcgugcugagcgucaugggguuccugcccgagcacuacgccucccagcucgaccgguacggcaaguuccugcccgagacggagcccaagcuggccugguacaaggacgacagcgggcgcuaccaguuccucuuccagaaguccuuccacgagaugcuggaggacuuccggcagcaccagccggagcugguggccggcgagaagaagauccccuacgacuggaccaucuacuaccuccgcaagaaggcccugagccaggagaucaccaaggaggagcuggcguggauccuccugaacuucaaccagaagcggggcuacuaccagcugcgcggggaggaggagcaggaggagaacaacaaguccguggaguaccacgcccucaaggucgugagcguggaggacuccggcgagcggaaggggaaggacaucugguacaacgucacccuggagaacggcuggguguaccgccgggccagcaacaucccccuggacuggacgggcaaggugaaggaguucgucgugaccaccgagcucgacgacgccgggaaccccaagaaggacaaggagggcaacgugaagcgcuccuuccgggcgccgaaggaggacgacugggggcugcugaagacccgcacgcaggcccagaucgacgagagcggcaagaccgucgggaccuacaucuacgagucccuccugugcaugcccaaccagaagauccgcggcaagcuggugcggaccaucgagcgcaaguacuacaaggacgagcuccggcagauccuggugaagcagagcgaguuccacgccgcccugcaggaccacaaccuccugcugagcugcaucgaggagcucuaccccaacaacgaggcccaccgccggcugcuguccgcgagcuccuucaucuacuuccucaucgaggacauccuguucuaccagcgcccccucaagagccagaagggccucaucgacaacugcccguacgagucccacaucuacaaggacaagaaggacgggagccugcaccacgucccccugaagugcguguccaagagccacccccucuuccaggaguuccggcuguggcaguuccuguccaaccugcgcaucuaccagcgggagcgcaugauggacggcagccucaagcuggacguggacgucacgcgggaguuccugcccuccgaggaggacuacgugaagcuguucgacuggcugaacgagcgcaaggagaucagccagaaguuccugcucgccuacaagccguucgggcugaagaagaacgagcaggccaacuaccgguggaacuacguggaggacaaguccuaccccugcaacgagacccgcgccgagaucaagagccggcuguccaaggccggcguccccgaggaguuccucaccgaggagaaggaggaggcgcuguggcacauccuguacagcaucuccgacaagaaggagcucaccaaggcccuggggacguucgccgccaagaacugccugaacgagagcuucguggaggucuucgccaagaucccgcccuucgaguccaacuacgcggccuacagccucaaggccauccgcaagcugcuggcccucaugcggaugggcaaguacuggaacgagcaggccaucgaccgccagacccgggaccgcaucgagaagauccugaccggcgaguacgacgagaccauccgcagccgggugcgcgagaaggcgaugcugcucacggacaucuccagcuuccgggggcugccccuguggcucgccugcuacaucguguacgaccgccacuccgagagcaaggagcuggucaagugggagacccccgccgacaucgaccacuuccuguccaaguucaagcagaacagccuccggaaccccaucguggagcaggucaucaccgagucccugcgcaccgugcgggacaucuggaagcaggagggcaagaucgacgagauccacguggagcuggggcgcgagaugaagaacccggccaaggagcgggcgcgcaucacggcccaggugcaggagaacgagaacaccaaccuccggaucaaggcccugcuggccgaguucaugaaccccgaguucgagaucgagaacguccaccccuacagccccggccagcaggagauccuccgcaucuacgaggacggggugcuguccggcaucgccgagaaggaccugccggacgacaucaccgcgauccucaagaaguuccgggagaacgacgugaagaagcgccccaccacgagcgagguccugcgguacaagcuguggcucgagcagcgcuaccggucccccuacaccggccgcgugaucccgcuggggaagcuguucacccccgccuacgagaucgagcacgugaucccccagagccgguacuucgacgacuccaucagcaacaaggucaucugcgaguccgccgugaacaagcucaaggacaacugccugggcuacgaguucaucaagaagcacagcggggagaugguggagcugggcaacggcgagaccguccccguguucuccguggaggaguacgagcgcuucgucaaggagagcuacuucgggaacagcaagaagaugaagaagcuccugcuggaggacaucccggacuccuucaucgagcggcagcucaacgacagccgcuacaucucccgcguggugacgagccugcuguccaaccucgucugcgaggagggcgagcaggacgggcugagcaagaacgugaucgugugcaccggcgggaucaccgaccggcugaagaaggacuggggcguccaggagguguggaaccgcaucauccucccccgguuccugcgccugaacgagaucaccggccggaccgacuucacguccaccagcgugaacgggcaccuccugcccgcccugccccucuaccugcagaagggcuucaacaagaagcgcaucgaccaccggcaccacgccauggacgcgaucgucaucgccugcgccaaccgcaacaucgugaacuaccugaacaacuccagcgcccggaagaacuccgagaucagccgcuacgaccuccagcggcugcugugcgagaaggugaagaccgacgccaacgggaacuacaaguggauccuccgcaagccgugggagaccuucacgcaggacgucuacgcggcccugaccaacaucgugguguccuucaagcagaaccugcgggucaucaaccgcaccaccaacuacuaccagcacuacaacgaggccggcgagaagcggaugaucccccagacgaagggggaccgcugggccauccggaagcccaugcacaaggacaccguguacggcgaggugaaccuccgcaaggagaagacccugccccugcgggacgucgugaagaacccgagcaucguggucgacaagucccucaagaacaagcuguacgagcugcucaagagccaguacgaccugaaggcgaucgccaaguacuucgagacccaccaggacgugugggccgacgugaaccugaagaagaucaaggucuacuacuucacgaaggagaccaacgagcgcuucuucgccacccgcaagucccucgaccccagcuucgaccagaagaagaucgaggaggaggugaccgacacgggcgugcagaagauccugcugcaccaccuccagcagaacaacaacgaccccgacauggccuucucccccgacgggaucgaccggaugaaccagaacaugaccauccugaacgacggcaaguggcaccagccgaucuacaagguccgcaccuacgagaaggcggacaaguucgccgugggggagagcggcaacaaggccaagaaguucguggaggccgccaaggggaccaaccuguucuucgcggucuacgagagcgugcaggaggacgaggccaucggcaagcaggucugcaagcggacguucgccaccaucccccucaacgaggugaucaagcgcaagaagcagggccugcccgccgcccccgaggaccugaacgggaaccucccgaaguucgugcugucccccaacgaccuggucuaccuccccaccgaggaggagcggaacagcucccgcaucauccagccccuggaccgggagcgcaucuacaagauggugagcuccagcggcucccagugcuucuucaucaagguguucgucgcgaacagcaucugggacaagaacgaguacuccagccugaacaagauggagcgggccaucaccaacgagaugaucaaggagaucugcgugccgaucaagaucgaccgccucgggaacgugucccugauccagaucuga

SEQ ID NO: 2269 - RNA, 4533 nt, Artificial Sequence
  Cas9 variant
augaagcgcauccugggccucgaccuggggaccaacagcaucggcugggcccugguggacuccgaggagcagcggauccucgggaugggcagccgcaucauccccauggaccaggggguccuggacaccuucuccggcggcaacccgguggagacgcagaccgccgcgcggaccguguaccgcgggacccggcgccugcgggagcgcgcccuccugcggcgcgagcggcugauccgcguccucaacaugaugaaguuccugcccgagcacuacgccagccagaucgacuucgagaagcggcugggccaguucuucgacgagaaggagcccaagcucgccuggaagcagaacgacgaggggcgcuucgaguucaucuuccagcaguccuucaacgagaugaucgaggaguucaagaacaagggcguggugcgggaggacaagaagauccccuacgacuggacgaucuacuaccugcgcaagaaggcccugagccaggagaucgagaaggaggagcucgcguggauccugcugaacuucaaccagaagcggggguacuaccagcuccgcggcgaggaggaggaggagaacccgaacaagcuggucgaguacuacucccugaagaucguggacgugaucgccgacgagaagcccaacagcaaguccgacaucugguacagccuccaccuggagaacggcuggaucuaccggcgcuccagcaagaucccccuguucggguggaaggacaagacccgggacuucaucgucaccaccgaccucaacgacgacggcacggugaagaaggacaaggaggggaucgagaagcgcuccuuccgcgcccccagcgagaacgacugggugcugcugaagaagaagaccgaguccgacaucgagaagucccacaagaccgucggcgccuacguguacgagacccuccugcagaacccgaugcagaaggugcggggcaagcugguccgcacgaucgagcggaaguucuacaaggacgagcucaagcagauccuggagaagcagcgcgaguuccaccccgagcugcgggacgaggaccucuacaacgacugcgugcgcgagcuguaccggagcaacgagaccuaccaguucauccugagcaagcgcgacuucgugcaccucuuccuggacgacauccuguucuaccagcggccccuccgcucccagaaguccgcgaucggggacugcauccuggaguucaagaccuacaaggacaaggacggcaacaacaucaaggaguaccugaaggucaucagcaagagcaacccccucuaccaggaguuccggaucuggcaguggcuguacaaccugaagaucuaccgcaaggaggacgacgaggacgugacccuccaguucaucgccaacaucgaggacaaggagcagcuguucgacuuccugagcaaccggaaguccaucgagcagaagccgcuccuggaguaccugaucaaggccaaggggcugaagaagcaggucaagacggaggccuaccgcuggaacuacguggaggacaagaucuaccccugcagcgagaccaagaccaugaucuccacccggcucgccaagguggagaacauccccgacaacuucuucacgaaggagaucgagcagaagcuguggcacaucaucuacagcgugaccgacaagaacgaguucgagaaggcgcugcgcaccuucgccaagaaguacgaccucgacaucgccuccuucgucgacaacuucaagaagaucccgccguucaagaacgaguacggcagcuucuccgagaaggccaucaagaagcugcugccccucaugcggcuggggaaguacuggaaguggaacgacaucgacaacaacacccagaaccgcaucagcaagaucaucacgggcgaguacgacgaggagaucaaggacaucgugcgggagaaguccaucgcccugaccaacgagaacgacuuccagggccuccagcuguggcuggcgcaguaccucgucuacgggcgccacagcgaggccgacaucgccggcaaguggcacuccguggccgaccuggagaaguaccugaacgaguucaagcagcacagccuccgcaaccccaucguggagcagaucaucaccgagacccugcgggucgugcgcgacaucuggcggaaguacgggcagggcgccgagaacuucuucuccgagauccacguggagcuggggcgcgacaugaagaacacggcggacgagcggaagaagaucgucaacguggugaccgagaacgagaacaccaaccuccgcaucaaggcccugcugauggagcucaagaacaacagcgacggcaagcuggaggucgagaacgugcggcccuacuccccgacccagcaggacauccugaagaucuacgaggaguacgccaucagcacgggccucgacaacgagaaggacgagaaggugaaggaggacaucaagaagaucucccgcgucgcccagcccaccaccaccgagcugcagcgguacaagcuguggcucgagcagaaguacugcagccccuacacggggaaggugaucccccugggcaagcuguucaccgaggaguaccagaucgagcacaucauccccaagagccgcuacuacgacgacuccuucagcaacaaggugaucugcgaggccgcggucaacaagcucaaggacaagugccuggggcuggaguucaucaagaacuaccacggccagaucguggagaccggguucggccagaaggugaccaucuucgacgaggaggccuaccagaacuucgucaagcagcacuacgccuacaaccacuccaagcggaccaagcuccugcuggaggagauccccgagaagaugaucgagcgccagaugaacgacacgcgguacaucagcaaguucgugcucccccugcuguccaaccucgugcgcgccaaggagaacgacaacggcgucaacagcaagaacgugcugcccgugaacgggaagaucaccaccaugcugaagcaggacuggggccucaacgacgucuggaacgaccugauccugccgcgguucgugcgcaugaacgagcucgcgaagaccaucgccuucacguccuggaacgagcagcaccagaaguaccugcccaccgugccccuggagcucagcaagggguuccagaagaagcggaucgaccaccgccaccacgccauggacgcccuggucaucgccugcgcgacccgggaccacgugaaccugcucaacaacaagcacgccaacaccgacacgauccgcuacgaccugcagcggaagcugcgccucuucgagcgcgugaccuacaucgacccgcagaccaagaacaacgucaccaaggacauccccaaggaguucaagaagcccugggacaacuucacgguggacgcccggaacgagcuggagaagaucaucguguccuucaagcagaaccugcgcaucaucaacaaggccaccaacaucuacaccaaguacgagaacggcaagaagaucaaggucggccagaaggggcucaacugggccauccggaagccccugcacaaggagaccguguucgcgaaggugagccugcgcaagcggaagacgguccgccucuccgaggcccugaaggacuggaagaagaucguggacaagaagcugaagcaggagaucaagcggcugaccugccaguacggcaaguucgacguggacaccauccugcgcuacuucaaggaccggaaguaccaguucggggaggucgacgugagcaaggugaagauguacuacuucgacgaggagaacgccgccguccgcaagaacguggacaccuccuucacggagaaguucauccagggcagcgugaccgacaccgggauccagaagauccugcucaaccaccuggaggccaagggcaacaaggucgagaucgcguucuccccggagggcaucgaggagaugaacaagaacaucauccagcugaacgaggggaagcuccaccuccccaucuucaaggugcggguguacgagaccaucggcaacaaguucagcgucggggugaagggcaacaagaaggacaaguacguggaggccgccaaggggacgaaccuguucuucgccaucuacgucgacgagaacggcauccgcuccuacgagaccaucccccucaacaucgugaucgagcggcugaagcagggccugagcgucgugcccgagaagaaccgcaaggagcacagccuccuguucuaccuguccccgaacgaccucguguacguccccaucgaggacgagcgggagaacauccacgcggugaaccuggaccagcugaacaacgagcagcgcaagcggaucuacaagauggugagcugcaccggguccgagugccacuucguccccuacuacguggccagccccaucgugaacaaggucgaguacuccagccucaacaagaucggccgcucccugaccggggagaugaucaaggacgugugcaucaagcugaagguggaccggcucggcaacaucaaggggaucagcggccuguga

SEQ ID NO: 2270 - RNA, 4533 nt, Artificial Sequence
  Cas9 variant
augaagcgcauccugggccucgaccuggggaccaacagcaucggcugggcccugguggacuccgaggagcagcggauccucgggaugggcagccgcaucauccccauggaccaggggguccuggacaccuucuccggcggcaacccgguggagacgcagaccgccgcgcggaccgccuaccgcgggacccggcgccugcgggagcgcgcccuccugcggcgcgagcggcugauccgcgugcucaacaugaugaaguuccugcccgagcacuacgccagccagaucgacuucgagaagcggcugggccaguucuucgacgagaaggagcccaagcucgccuggaagcagaacgacgaggggcgcuucgaguucaucuuccagcaguccuucaacgagaugaucgaggaguucaagaacaagggcgucgugcgggaggacaagaagauccccuacgacuggacgaucuacuaccugcgcaagaaggcgcugagccaggagaucgagaaggaggagcucgccuggauccugcugaacuucaaccagaagcggggguacuaccagcuccgcggcgaggaggaggaggagaacccgaacaagcugguggaguacuacucccugaagaucgucgacgugaucgccgacgagaagcccaacagcaagggcgacaucugguacucccuccaccuggagaacggguggaucuaccggcgcagcuccaagaucccccuguucggcuggaaggacaagacccgggacuucaucgugaccaccgaccucaacgacgacgggacggucaagaaggacaaggagggcaucgagaagcgcagcuuccgcgcccccuccgagaacgacugggugcugcugaagaagaagaccgagagcgacaucgagaagucccacaagaccgugggcgcguacgucuacgagacccuccugcagaacccgaugcagaaggugcgggggaagcuggugcgcacgaucgagcggaaguucuacaaggacgagcucaagcagauccuggagaagcagcgcgaguuccaccccgagcugcgggacgaggaccucuacaacgacugcguccgcgagcuguaccggagcaacgagaccuaccaguucauccuguccaagcgcgacuucgugcaccucuuccuggacgacauccuguucuaccagcggccccuccgcagccagaaguccgccaucggcgacugcauccuggaguucaagaccuacaaggacaaggacgggaacaacaucaaggaguaccugaaggugaucagcaagagcaacccccucuaccaggaguuccggaucuggcaguggcuguacaaccugaagaucuaccgcaaggaggacgacgaggacgucacccuccaguucaucgccaacaucgaggacaaggagcagcuguucgacuuccuguccaaccgcaagagcaucgagcagaagccgcuccuggaguaccugaucaaggccaagggccugaagaagcaggucaagacggaggccuaccgguggaacuacguggaggacaagaucuaccccugcuccgagaccaagaccaugaucagcacccggcucgcgaagguggagaacauccccgacaacuucuucacgaaggagaucgagcagaagcuguggcacaucaucuacuccgugaccgacaagaacgaguucgagaaggcccugcgcaccuucgccaagaaguacgaccucgacaucgccagcuucguggacaacuucaagaagaucccgccguucaagaacgaguacggguccuucagcgagaaggccaucaagaagcugcugccccucaugcggcugggcaaguacuggaaguggaacgacaucgacaacaacacccagaaccgcaucuccaagaucaucacgggcgaguacgacgaggagaucaaggacaucguccgggagaaguccaucgcgcugaccaacgagaacgacuuccaggggcuccagcuguggcuggcccaguaccucguguacggccgccacagcgaggccgacaucgccgggaaguggcacagcgucgccgaccuggagaaguaccugaacgaguucaagcagcacucccuccgcaaccccaucguggagcagaucaucaccgagacccugcgggugguccgcgacaucuggcggaaguacggccagggggcggagaacuucuucagcgagauccacguggagcugggccgcgacaugaagaacacggccgacgagcggaagaagaucgugaacgucgugaccgagaacgagaacaccaaccuccgcaucaaggcccugcugauggagcucaagaacaacuccgacggcaagcuggagguggagaacguccggcccuacagcccgacccagcaggacauccugaagaucuacgaggaguacgccaucuccacggggcucgacaacgagaaggacgagaaggugaaggaggacaucaagaagaucagccgcguggcccagcccaccaccaccgagcugcagcgguacaagcuguggcucgagcagaaguacugcucccccuacacgggcaaggucaucccccuggggaagcuguucaccgaggaguaccagaucgagcacaucauccccaagagccgcuacuacgacgacagcuucuccaacaaggugaucugcgaggcggccgugaacaagcucaaggacaagugccugggccuggaguucaucaagaacuaccacgggcagaucgucgagaccggcuucggccagaaggugaccaucuucgacgaggaggccuaccagaacuucgugaagcagcacuacgccuacaaccggagcaagcgcaccaagcuccugcuggaggagauccccgagaagaugaucgagcggcagaugaacgacacgcgcuacaucuccaaguucguccucccccugcugagcaaccucgugcgggcggaggagaacgacaacggggugaacuccaagaacguccugcccgugaacggcaagaucaccaccaugcugaagcaggacugggggcucaacgacguguggaacgaccugauccugccgcgcuucguccggaugaacgagcucgccaagaccaucgccuucacgagcuggaacgagcagcaccagaaguaccugcccaccgugccccuggagcucuccaagggcuuccagaagaagcgcaucgaccaccggcaccacgccauggacgcccuggugaucgcgugcgccacccgcgaccacgucaaccugcucaacaacaagcacgccaacaccgacacgauccgguacgaccugcagcgcaagcugcgccucuucgagcgggugaccuacaucgacccgcagaccaagaacaacgugaccaaggacauccccaaggaguucaagaagcccugggacaacuucacggucgacgcccgcaacgagcuggagaagaucaucgugagcuucaagcagaaccugcggaucaucaacaaggccaccaacaucuacaccaaguacgagaacggcaagaagaucaagguggggcagaagggccucaacugggcgauccgcaagccccugcacaaggagaccgucuucgccaaggugucccugcggaagcgcaagacggugcggcucagcgaggcccugaaggacuggaagaagaucgucgacaagaagcugaagcaggagaucaagcgccugaccugccaguacgggaaguucgacguggacaccauccugcgguacuucaaggaccgcaaguaccaguucggcgagguggacgucuccaaggugaagauguacuacuucgacgaggagaacgccgccgugcggaagaacgucgacaccagcuucacggagaaguucauccagggguccgugaccgacaccggcauccagaagauccugcucaaccaccuggaggcgaagggcaacaagguggagaucgccuucagcccggaggggaucgaggagaugaacaagaacaucauccagcugaacgagggcaagcuccaccuccccaucuucaagguccgcguguacgagaccaucgggaacaaguucuccgugggcgucaaggggaacaagaaggacaaguacguggaggccgccaagggcacgaaccuguucuucgcgaucuacguggacgagaacggcauccggagcuacgagaccaucccccucaacaucgucaucgagcgccugaagcaggggcuguccgugguccccgagaagaaccggaaggagcacagccuccuguucuaccugagcccgaacgaccucguguacgugcccaucgaggacgagcgcgagaacauccacgccgucaaccuggaccagcugaacaacgagcagcggaagcgcaucuacaagaugguguccugcaccggcagcgagugccacuucgugcccuacuacgucgccucccccaucgugaacaagguggaguacagcucccucaacaagaucgggcggagccugaccggcgagaugaucaaggacgucugcaucaagcugaagguggaccgccucgggaacgugaagggcaucuccggccuguga

SEQ ID NO: 2271 - RNA, 4536 nt, Artificial Sequence
  Cas9 variant
augaagaagauccugggccucgaccuggggaccaacagcaucggcugggccgugaucaacagcgucgccgacgagagcguggagaagcgcaacaucgagcuggcggggucccggaucauccccauggacgccgccgugcucggcaacuucgacaacggggucaccaagagccagacggccgagcgcaccuccuaccggagcauccgccggcugcgcgagcggcagcugcuccgccgggagcgccugcacaaggugcugcagauccucggcuuccugccggagcacuacgugaacgacaucgacuucgagaaccaccccggcaagaucaagaagaacaccgagcccaagcugcccuggcggaagaacuccauggggcaguucgaguucaucuuccaggccagcuucgaggcgaugcucaccgacuucgccacgcaccagccggucuucguguccgagggcaagaaggugcacuacgacuggacccuguacuaccugcgcaagaaggcccucaccgaggagaucagcaaggaggagcuggccuggaucauccugaacuucaaccagaagcggggguacuaccagcuccgcggcgaggaggaggaggagcaguccaacaagcuggucgaguucuacgcgcugcggguggugaaggucgaggccaccgacgacaagaaggggaaggacacgugguacaacgugcaccucgagaacggcuggaucuaccgccggaccagcaacaucccccuggacugggagggcaaggugaaggaguucaucgucaccaccgaccugaacgaggacgggacgcccaagcucgacaaguacggcgaggugaagcgcuccuuccgggcccccaaggaggacgacuggacccugaucaagaagaagaccgagagcgacaucgccaacucccacaagacccuggggugcuacaucuacgacgcccuccugcagaacccgaaccagaagaucaagggccgccuggugcggacggucgagcgcaaguucuacaaggaggagcuccgccugauccuggagaagcagcucagcuuccaccccgagcugcaggaccgggaccuguaccgcgcgugcaucgacgcccucuacguguccaacgaggcccacaagaacaacaucagcggccgggacuucguguaccuguucaucgacgacaucaucuucuaccagcgcccccugaagaccaagaagucccucaucgacaacugccccuacgagaagaaccaguacauggaccgggagaccggggaggucaagcaggccccgaucaagugcaucgccaagagccacccccuguuccaggaguuccgccuguggcaguucaucagcaacauccggaucuaccagcgcgagcgggugauggacgacggcaagcucgagaccgacguggacgucacgcccgacuuccugaagaccgaggacgacuacaccacccuguucgaguggcucaacgaccgcaaggagguggaccagaaggcguuccugaagaacccccaguucgggcugaagaagacguucaccgaguaccgguggaacuacgucgaggacaaguccuacccgugcaacgagacccgcaacgccauccucaacggccugcagaaggccggggugagcgccgacuuccugucccgggagguggaggaggcccuguggcacauccucuacagcgucgaggacaagaucgagaucgaguccgcgcugcgcaaguucgccagcaagcacgaccuggacgaccgguucgccgacguguucaagaagcucccgcccuuccgcaaggaguacggcgccuacuccgccaaggcgaucaagaagcugcugccccucaugcggaugggcaaguacugggagcugagcaacaucgacgacaagaccaaggagcgcaucgacaagaucaucacgggggagugggacgagaacauccacaaccgggugcgcgagaaggccaucaagcuguccgacaucaccgacuucaagggccucccccuguggcugagcugcuacgucguguacaaccgccacuccgaggcccgggccaucgcgaagugggagagccccgaggacaucgacuccuaccuccgccuguuccggcagcacagccugcgcaaccccguggucgagcaggucaucaccgagacccuccggacggugcgcgacaucuggaagcggaucgggcagaucgacgagauccacguggagcugggccgcgagaucaagaaccccgccgacaagcgggccaagaugaccgcccagaucguggagaacgagaacaccaaccugcgcaucaaggcccuccuggcggaguucaucaacuccgaguacgagaucgagaacgugcggccguacagccccgggcagcaggagauccugcgcaucuacgaggacaccguccucaacuccguggaggagauccccgaggacaucagcgccgugcugaagaaguuccgggaguccgaccugaagaagcgccccaccaagagcgaguuccuccgguacaagcuguggcuggagcagaaguaccgcagcccguacacgggcgacaucaucccccucggcaagcuguucaccuccgccuacgagaucgagcacaucaucccccagagccgguacuucgacgacuccuucagcaacaaggucaucugcgaggccgaggugaacaagcugaaguccaacgagcucggguacgaguucaucaagaaccaccacggccaguacguggagaucggguucggcaaggucgugcagaucuucagcaucgaggccuacgagaaguucgugaaggcgaacuacuccgggaucggcagcaagaugaagcgccugcugauggacgacaucccggagaccuucaucgagcggcagcucaacgacucccgcuacaucagcaaggucgugaagucccugcugagcaacaucgugcgggagaaggacuccaacggcgaguacgagcccgaggccaucagcaagaacgucaucgugugcaccggguccgugacggaccgccucaagcgcgacuggggcgucaacgacguguggaacagcaucaucuacccccgguucgagcgccugaacgagcugaccgggucccagcaguucggcugcugggagaacaaggagggcaagcggguguuccagaccgccgucccccucgagaugcagaagggguucagcaagaagcgcaucgaccaccggcaccacgccauggacgccaucgugaucgcgugcgccauccgcaaccacaucaacuaccugagcaacgaguccgccagcaagaaggccaagaucucccggaucgaccugcagcgccuccugugcaccaagugccggacggacgacaacggcaacuacaaguggaucgugaagaagccguggcccgcguucacccaggacauccgcaaggcccuggagaacaucaccgucagcuucaagcagaaccuccgggugaucaacaagaccacgaacuacuacgugcacuucgacgaguccgggaagaagguccuggagaagcagaucaacggcgacagcugggccauccgcaagcccaugcacaaggacaccguguucgggaaggugaaccugcagaaggucaaggaggugcggcucucccuggcccuggacacccccaagaugaucguggacaagaagcucaaggagaagguccugcagcuguacagcuacaaguacgacaagaagcgcaucgacaaguacuucaaggagaacgccucccucuggaaggaccugaaccugagcaagguggcgguguacuacuucaccaacgacuccacggagccgcucgucgccgugcggaagccccuggacaccagcuucaacgccaagaagaucaaggaguccgugaccgacaccggcauccagaagauccugcucaaccaccugagcaacaaccaggacaaccccaaccuggccuucucccccgacggcaucgacgagaugaaccgcaaccucacgacccugaacgacgggaaguaccaccagccgaucuacaagguccgggugugcgagccccagggcaacaaguucagcgucgggaccuccggcaacaagaccagcaaguacguggaggccgcgaaggggacgaaccuguucuucgccguguaccagaccgaggacggcaagcgcaacuacgagaccaucccccucaacgucgugaucgagcgggagaagcuggagugggcccccgugccggagaacaacaacaacggcgacaagcuccuguucuggcugucccccaacgaccuggucuacgugcccaccgccgacgagcucaacaacgggaugcgccuggacaacauggacaagggccgcaucuacaagaugaucagcugcagcgggccccagugcuucuucaucccgcagaacguguccaaccccaucauccccgucaucgagcugggcgugaacaacaaggccgagaaguccuggaacaacgagaugaucaagguggucugcgugcccauccggguggaccgccucgggugcaucacgcagaucaacaaccagaaguga

SEQ ID NO: 2272 - RNA, 4539 nt, Artificial Sequence
  Cas9 variant
augaagaagauccugggccucgaccuggggaccaacagcaucggcugggcccugaucgagaacuccuucaccgagaaggaggggaagaucaacgacaugggcgugcgcaucauccccaugagcgccgacauccucgggaaguucgacgcgggccagucccacagccagacggccgagcggaccggcuaccgcgggacccggcgccuguaccagcgggacaaccugcgccgggagcgccuccaccggguccugcacauccugggcuuccucccgaagcacuacgacgagcacaucgacuucgagaagcgccuggggcaguucaaggagggcaaggagaucaagcugaacuaccggugcaacguggagaacaagcacgaguucaucuucaucuccagcuucaacgagaugcucaccgaguucaagaaggcccagcccgagcuguucuaccugaaguccaacggggaggagacgaagauccccuacgacuggacccucuacuaccugcgcaagaaggcccugagccagccccucaccaagcaggagcuggccuggaucauccugaacuucaaccagaagcggggcuacuaccagcuccgcggcgaggagaucgacgacgacaagaacaagcaguucgugaagcugaaggucaaggaggugaucaacuccggggaggcggugaagggcaagccgcuguucgacgucaucuucgagaacggguggaaguacgacaagcaggucgugaagaccgaggacuggaucgaccggacgaaggaguucaucgugaccaccaaggugcucaagaacggcgaccugaagcgcagcuacaagaccguggacuccgagaaggacugggccgccaucaaggccaagacggagcaggacaucgagcggagcaacaagaccgucggcgaguucaucuacgagacccugcucgagaaccccacccagaagauccgcgggaagcuggugaagacgaucgagcggaaguucuacaaggaggagcugaagaacauccucaucaagcagaucgagcugcagcccacccuguucuccgaggagcucuacaaggcgugcaucgaggagcuguacccccgcaacgaggcccaccagaacgccaucaagaaccgggacuucaucuaccugcucauggacgacaucaucuucuaccagcgcccgcucaagagccagaaguccaacaucagcggcugccagcuggagcagcgcguguacuacaaggccaacaaggacuccggggagaacgaggaggucaagcaggccgugaaggcgauccccaagagccacccccuguuccaggaguuccggaacuggcaguggcugcagaaccugaagaucuacaacaagguggacaccgagaagggcgagcucaccgacgucacgaagcagcugcugcccuccgaggacagcugggugaaccucuucaacuuccugcagugcaagaaggagcuggagcagaagcaguucaucaaguacuucaucgacaagaagcucaucaacaagaccgagaaggaccacuaccgcuggaacuacguggaggacaagaaguacccguucaccgagacccgggcccaguucaucagccgccugacgaaggucgaggggaucgaggagaucaacaccuuccuggacaagaagacccagaucggcaccaaggacaacucccccuucgugagccggaucgagcagcuguggcacaucaucuacuccgugagcgacaucaaggaguacgaguccgcccucgagaaguucgccaucaagcaccaccugaacgaggagagcuucgucgccaacuucaucaaguucccgcccuucaaguccgacuacggcagcuacuccaagaaggcgcugaacaagcuccugccccugaugcgccgggggaacuacuggacggagaacgacaucagcgagaaggugaagcuccgcgucuccgagaucauggagcgggugaacgcccugaaccugaaggaggacuacagcuccaaggagcucgccgagacccuggugaacgucagcgacgacgacgugaagaagcagcugaucaaguccuucgugagcuucaaggaccgcaacccccucaugggccugaacaccuuccaggccaccuaccuggucuacgggcggcacuccgaggugggcgacauccagaacuggaagacgcccgacgacaucgacaccuaccucaagaacuucaagcagcacagccugcgcaaccccaucguggagcaggucgugaccgagacccugcgggugguccgcgacaucuggaagcaccacgggaagucccagacgaacuucuucaacgagauccacguggagcucggccgggagaugaagaacccggccgacaagcgcaagcggaucagcgagcgcaacaccgagaacgagaacaccaacaaccggauccgcgagauccugaaggaccugaugaacgacgcgagcauccagggcgacgugcgcgacuacucccccagccagcaggggauccucaagaucuacgaggagggcgucuaccagaaccccaagguggacuacuccaaggugagcgaggacgagaucaccaagauccggcgcuccaacaaccccacccagaaggagauccagcgguaccgccuguggcuggagcagggguacaucagcccguacacgugcaagcccaucccccucuccaagcuguucacccaccacuaccagaucgagcacaucaucccccagagccgguacuucgacaacuccagcuccaacaagaucaucugcgagagcgaggucaacgaggacaaggacaacaagaccgccuucgaguaccugaaggacaagggcgagaacgugaucaacgggcacaagcuccugucccuggccgccuacgaggcccacgugaacaaguacuucaagaacaaccgccagaagcucaagaaccugcugagcgaggacaucccggagggcuucaucaaccggcagaugaacgacucccgcuacaucagcaagcucgucaagggccugcuguccaacaucgugcgggaggagggggagcaggaggugaccagcaagaaccucauccccgucacgggcagcgugaccuccaagcugaagaacgacugggggcugaacgacaaguggaacgagcucauccugccccgcuucaagcggcugaaccagcucacccagaccaacgacuucacgaccgcgaacaccaacggcaacaccaucccgacggugcccgacgagcugcugaagggcuucagcaagaagcgcaucgaccaccggcaccacgcccucgacgcccuggucguggccugcugcacccgcaaccacuccaacuaccugagcgcgcucaacaccgagaacaagaacuacgggcugcgggacaagcugcucaucaagaacgacaacgaccacuacaccaaguccuuccagaugcccuggcacggcuucacgaccgaggccaagaaccagcuggaggagaccgugaucagcuucaagcagaaccugcgcgucaucaacaaggccaacaacaaguucugguccuacaaggacgagaacgggaagcucaaccuggacaagaacggcaagcccaucaagaagcugcggaagcagaccaagggggacaacugggccgugcgccagccgcuccacgaggagacgaucagcggcaucgugaaccugcccugggucaaggccgagaaggagaaguucaccuacgcgacccggaagucccuggacaagagcuucgaccucaagaagaucgagaagaucaccgacacgggcauccagaagauccugcgcaacuaccugaugcaggagaaguucaaggagcucgacaagaaggacaaggagguguacaacuccgagcuggccuucagccaggaggggcuggaggaccucaacuccaacaucgagcaguucaacgaccagaagccccacaagcccaucuacaaggugcggcuguucgagaagggcagcgggcgcuucgcccugggcuucaaggggaucaacgccaagaaguacgcccagggcuccccgaaccucuacuucaacaucuaccgcaacgaggacggccaguacuacgagaccgucccccugaacaaggugaucauccaccagaagaacgcggccaacaugcccaagaagaaccggacccccgugccgaucagcaacaccgccaucaaccgcuccaaggagguccugguggacuacaagaugacgcucagcccccuggaccugguguacauccccaccgaggaggagcucaacaacaucaacucccuggacuucaacaaccugagcaagagccagcggaagcgccucuacaacgucaacgacuucuccggguacaccaucuacuucagccccaacacccuggccaaguccaucugcccgaaggagguggacaugaaguucgacgagaagaagcagaagcccacgggcagcuucgacuccaagaccgccagccuggacgggauguccaucaaggagcggugcaucaagcucaucaucgaccgccugggcaacaucagcaaggcguga

SEQ ID NO: 2273 - RNA, 4539 nt, Artificial Sequence
  Cas9 variant
augaagaagauccugggccucgaccuggggaccaacagcaucggcugggccguggucaacgccgacgagaucacccgcgacgacgggucccgguaccugaagcccaacggcaucagcgcggccgggucccgcaucaucccgaugagcgccgacauccucggcgacuucgagaagggcaacuccaucagccagacggccgagcggacccgcaugcggauggcccgccggcugcacgagcgcgcgcugcuccggcgcgagcggcugcugcgcgugcucaaccugcuggacuuccuccccaagcacuucgccgacaagaucgaccgguacgggaaguucaccgacgacuccgagcccaagcuggccuggcgcaagaacaccgagggcaaguacgaguucaucuuccaggacgccuucaacgagaugcuggcggaguucaaggacaagcagcccgagaucguggaggaggggaagaagaucccguacgacuggacgaucuacuaccuccggaagaaggcccuggagaaggcccugagcaaggaggagcucuccuggauccugcugcaguucaaccagaagcgcggcuacuaccagcuccgcggggaggaggaggagaucccccaggacaagaagaucgaguaccuggcccagaaggucgugaagguggaggccaccgaccagaagaagggcgacgacgucugguacaacguguaccuggagaacggcaugaucuaccggcggaccagcaaggcgccccucgacugggaggggaaggugaaggaguucaucgucaccacggagguggagaacgacggcgagacccccaagaaggacaaggaggggaacaucaagcgcuccuuccgggccccgaaggaggacgacuggacccugcugaagaagaagaccgaggccgacaucgagaacagccacaagacggugggcugcuacaucuacgacucccuccugaacaaccccaagcagaagaucaucggcaagcugguccgcaccguggagcgcaaguucuacaaggaggagcucacccagauccugaagaagcaggucgagcugauccccgagcuccgggacgacaaccuguacaagcagugcaucgaggagcuguaccccaucaacgaggcccaccgcaacaccaucgccaagacggacuucgcgaaccucuucaucaacgacauccuguucuaccagcggccgcucaagagcaagaagucccagaucgacaacugccccuacgaggagcgcaucuucaucgacagcaagaccggggagaagaagaaggugcccgugaagugcaucgccaaguccaacccccuguuccaggaguuccggcuguggcaguucauccagaaccugcgcaucuaccagcgggagaaggagaucgacggcaagcuccugaccgacaucgacaucaccagcgagugccugaaguccgaggaggacuacgugcgccucuucgacuggcugaacgaccgggagacgaucgagcaggaggaccugcucaagcaccuguucaacaccaagaaguccaagaacaaggagaacccguaccgcuggaacuacgucgaggacaagguguaccccugcaacgagacccgggccaccauccugaagggguucagcaagugcggcaucaacgccagcgugcugagccccgagcucgagauggcccuguggcacauccuguacuccgucgaggacaagaaggagaucgagacggcgcucacccacuucgcccagaagcagggguggaacgacgacuucgccaagguguucagcaaggccaagcccuucaagaaggacuacggcuccuacagcgagaaggccaucaagaagcugcugucccucaugcgcaugggcaaguacuggaaccaggacaacaucgacaagaacacccuggaccggaucgacaagaucaucaacggggaguacgacgagaagaucagcaaccgcgugcgggacaacgcgaucaaccugaaggacaucuccgacuuccgcggccucccggucuggcuggccugcuacaucguguacgaccggcacagcgaggccaaggacugcaccaaguggaacucccccgaggagaucgacagcuaccugaagaaguucaagcagcacucccuccgcaaccccaucgucgagcaggucgugacggagacccugcggaccgugcgcgacaucuggauccaggaggagcagaucgacgagauccaccuggagcucgggcgcgaccugaagaaccccgccgacaagcggaagaagaugagcgagaacauccugaagaacgagaacaccaaccuccgcaucaaggcgaugcugauggaguucaugaacccguccaugggcaucgagaacgugcggcccuacagccccucccagcaggacauccugcgcaucuacgaggagaacgcccucgacaaccugacgaaggacgacaaggacuucgacuucaucagcaagaucuccaagcaggcccagcccagcaagaccgacaucauccgguacaagugcuggcuggagcagaaguaccgcagcccguacaccgggaagaccaucucccucagcaagcuguucacgcccgccuacgagaucgagcacgugaucccccagucccuguacuucgacgacagcuucuccaacaaggucaucugcgaggccgaggugaacaagcucaaggaccggcagcugggcuacaaguucaucgcggagcaccacggcgagaaggugcagcugagccagggggaggucguggagauccucuccguggacgccuacgagaaguucgucaaggagaacuacgccaacaaccgcaucaagaugaagaagcugcugauggagagcaucccggacgaguucaucgagcggcagcucaacgacucccgcuacaucagcaagguggugaagggccugcuguccaacaucguccgggagaagaucgacgacgagaacuacgagcccgaggccgugagcaagaaccucaucuccugcaacggggccaucaccgaccgccugaagaaggacuggggcaugaacgacguguggaacagcaucauccugccccgguucauccgcaugaaccagaucaccgggaaggacugcuucaccaccacgaacgcggagggccaccucaucccccagaugccgcuggagcugcagaagggcuucaacaagaagcggaucgaccaccgccaccacgccauggacgccaucgucaucgccugcaccacccgggaccacgugaaccuccugaacaacgaggccgcgcacuccaaguucaacgccacccgcuaccagcugcagcggaagcuccgccgguucgagaaggccgugaucgacgggaaggagcgcgaggucgccaaggaguuccugaagcccugggacagcuucuccagcgacagcaagaacauccuggagaacaucaucguguccuucaagcagaaccagcgcgugaucaacaagacgaccaacgcguuccuccacuucgacgagaacggcaagaagaccuucaucaagcaggggaagggcgacagcugggccauccggaaguccaugcacaaggacaccgucuucggcgagaucaaccugcgcaaggugcggagcgugucccugaacgaggccaucaagguccccgagcgcgugcucaacaagaagaucaaggagaagauccuggagcugaagaacaacaagaucgacgccaagaacaucaagaaguacaucgaggagaaccacaccgggggcuacgggaucgacagcuccaagaucgacguguucuacuucacgaaggagaccaaggagcgguucuucgccacccgcaagacgcucgacaccagcuucaaccaggcgaagaucaaggacuccaucgccgacagcggcauccagaagauccugcuggcccaccucaaguccaagaacggggacgccgagcaggccuucagccccgacggcaucgacgagaugaacaagaacaucgucgagcugaacaacggcaaguuccaccagccgauccugaaggugcggguguacgagaaggcggacaaguucgccgucgggcagaagggcaacaagaaggugaaguucguggaggccgccaaggggaccaaccucuucuucgccaucuucgagaaggacggcaagcgcuccuaccugaccaucccccugaacgucaugaucgacugccagaagcaguacgggaaccaguggaagaacaacaucgaggcguaccucaaggagaaggagcugguggagaaggacgugaagcugcaguucauccucagccccaacgaccuggucuaccugcccacggagggcuccaucgacaagaagcggaucuacaagguggugagcuucaccaacaaccgccucuacgccaucccguacgccaucgccaaguccaucgucgacaagaacgaguucacccagcugaacaagaucgaguucaccgacaacaaggagagcaucaaggacgcgugcgugcccgugaucaucgaccggcugggcaacgucaucgaguucaacgggaagcgccucuga

SEQ ID NO: 2274 - RNA, 4539 nt, Artificial Sequence
  Cas9 variant
augaagaacauccugggccucgaccuggggaccaacagcaucggcugggccgugaucaacagcgaggaggacgggcccaucgucaagaagcgcaucgagcuggccggcagccggaucaucccgauggacgcggccgugcucgggaacuucgacuccggcgugaccaagagccagacggccgagcgcaccuccuuccggagcauccgccggcugcgcgagcggcagcugcuccgccgggagcgccugcacaagguccugcagauccucggcuuccugcccgagcacuacgugaacgacaucgacuucgagaaccaccccgggaagaucaagcggaacaccgagcccaagcugccguggcgcaagaacuccaugggccaguucgaguucaucuuccaggacagcuucgaggccaugcucaccgacuucgccacgcaccagcccguguucgucuccgaggggaagaaggugcccuacgacuggacccuguacuaccugcggaagaaggcgcucaccgagggcaucagcaaggaggagcuggccuggcugauccucaacuucaaccagaagcgcggguacuaccagcugcggggcgaggaggaggaggagcaguccaacaagcugguggaguucuacgcccuccgcgucgugaagguggaggccaccgacgacaagaagggcaaggacacgugguacaacguccaccuggagaacggguggaucuaccggcgcaccagcaacaucccccuggacugggagggcaaggugaaggaguucaucgugaccaccgaccucaacgaggacgggacgccgaagcuggacaaguacggcgaggucaagcgguccuuccgcgcgcccaaggaggacgacuggacccugaucaagaagaagaccgagagcgacaucgccaacucccacaagaccgugggcugcuacaucuacgacgcccuccugcagaacccccaccagaagaucaaggggcggcuggugcgcacggucgagcgcaaguucuacaaggaggagcuccggcugauccuggagaagcagcucagcuuccaccccgagcugcaggaccgcgaccuguaccgggccugcaucgacgcccucuacguguccaacgaggcgcacaagaacaacaucagcggccgcgacuucguguaccuguucaucgacgacaucaucuucuaccagcggccgcugaagaccaagaagucccucaucgacaacugccccuacgaggagaaccaguacauggaccgcgagaccggggaggucaagcaggcccccaucaagugcaucgccaagagccacccccuguuccaggaguuccggcuguggcaguucaucagcaacauccgcaucuaccagcgggagcgcgugcucgacgacggcaagcuggagaccgacguggacgucacgccggacuuccugaagaccgaggacgacuacaccacccucuucgagugguucaacgaccggaaggagguggaccagaaggccuuccugaagaacccccaguucgggcugaagaagacguucaccgaguaccgcuggaacuacgucgaggacaaguccuaccccugcaacgagacccggaacgccauccucaacggccugcagaaggcgggcgugagcgccgacuuccugucccgcgagguggaggaggcccuguggcacauccucuacagcgucgaggacaagaucgagaucgaguccgcccugcggaaguucgccagcaagcacgaccuggacgaccgcuucgcggacguguucaagaagcugcccccguucaagaaggaguacggggccuacuccgccaaggccaucaagaagcugcugccccucaugcggaucggcaaguacugggagcugagcaacaucgacgacaagaccaaggagcgcaucgacaagaucaucacgggggagugggacgagaacauccacgaccgggugcgcgagaaggccaucaagcuguccgacaucaccgacuucaagggccucccccuguggcugagcugcuacgucguguacaaccgccacuccgaggcgcgggccaucgccaagugggagagccccgaggacaucgacuccuaccuccgccuguuccggcagcacagccugcgcaacccgaucguggagcaggucaucaccgagacccuccggacggugcgcgacaucuggaagcggguggggcagaucgacgagauccacgucgagcugggccgcgagaucaagaaccccgccgacaagcgggcgaagaugaccgcccagaucguggagaacgagaacaccaaccugcgcaucaaggcccuccuggccgaguucaucaacuccgaguacgagaucgagaacgugcggcccuacagcuccaaccagcaggagaagcugaagaucuacgaggacaccguccucaacggcgugaaggagauccccgaggacaucaacacgauccugaagaaguuccgcgagagcgaccugaagaagcggccgaccaaguccgacuuccuccacuacaagcuguggcuggagcagaaguacugcagccccuacaccgggcgcaucaucccccucggcaagcuguucaccagcgccuacgagaucgagcacaucaucccgcaggcgcacuacuucgacgacuccuucagcaacaaggugaucugcgaggccgaggucaacgggcugaaggacaagaagcucggcuacgaguucaucaagcacaaccccgggaagaugguggagaucggcuucggcaagccgcccgugcggaucuucuccgucgaggaguacgagcgcuucgugaaggagaacuacagcgggaucaagaacaagaugaacaagcugcugauggacgacauccccgagaccuucaucgagcggcagcucaacgacucccgcuacaucagcaagguggucaagucccugcugagcaacaucgugcgggagaaggacuccaacggcgaguacgagcccgaggccaucagcaagaacgugaucgucugcacgggguccgugaccgaccgccucaagcgggacuggggcgugaacgacgucuggaacagcaucaucuacccccgcuucgagcgccugaacgagcugaccggcucccagcaguucgggugcugggagaacaaggagggcaagcggguguuccagaccgccgugccccucgagaugcagaagggguucagcaagaagcgcaucgaccaccggcaccacgccauggacgcgaucgucaucgccugcgccacgcgcaaccacaucaacuaccuguccaacgagagcgccuccaagaaggccaagaucagccggaccgaccugcagcgccuccugugcaccaagugccggaccgacgacaacggcaacuacaaguggaucgugaagaagccguggcccgcguucacgcaggacauccgcaaggcccuggagaacaucaccgugagcuucaagcagaaccuccgggucaucaacaagaccaccaacuacuacgugcacuucgacgaguccgggaagaaggugcuggagaagcagaucaacggcgacagcugggccauccgcaagcccaugcacaaggacacggucuucggcaaggugaaccugcagaaggugaaggagguccggcucucccuggcccuggacacccccaagaugaucguggacaagaagcucaaggagaaggugcugcagcuguacagcuacaaguacgacaagaagcgcaucgacaaguacuucaaggagaacgcgucccucuggaaggaccugaaccugagcaaggucgccguguacuacuucaccaacgacuccaccgagccgcucguggccguccggaagccccuggacacgagcuucaacgccaagaagaucaaggaguccgugaccgacaccgggauccagaagauccugcucaaccaccugagcaacaaccaggacgaccccaaccuggccuucucccccgacggcaucgacaagaugaacaagaaccucaccgcgcugaacgacgggaaguaccaccagccgaucuacaaggugcgcgucugcgagccccagggcaacaaguucagcguggggacguccggcaacaagaccagcaaguacgucgaggccgccaagggcaccaaccuguucuucgccguguaccagaccgaggacgggaagcgguccuacgagacgaucccccucaacguggucaucgagcgcgagaagcugggcuggacccccgugccggagaacaacaacaacggggacaagcuccucuucuggcugagccccaacgaccugguguacguccccaccgccgacgagcucaacaacggcaugcggcuggacaacauggacaaggggcgcaucuacaagaugaucuccugcagcggcccccagugcuucuucaucccgcagaacguguccaacgcgaucauccccgugaucgagcugggcgccaacaacaaggccgagaaguccuggaacaacgagaugaucaaggucgugugcgugcccauccgggucgaccgccucgggugcaucacccagaucaacaaccagaaguga

SEQ ID NO: 2275 - RNA, 4551 nt, Artificial Sequence
  Cas9 variant
augaagaacauccugggccucgaccuggggaccaacagcaucggcugguccgugauccaggagaagcacaacgagaacaacgagugccagaagcugauccucggggccggcagccgcaucauccccauggacgccgcgguccugggggacuucgccaagggcaacaccaucucccagacgaaggaccggacccaguaccgcggcgugcggcgccugcgggagcgcugccuccugcggcgcgagcggcuguuccgcgugcucgacaucaugggguuccugccgcagcacuucagcaacgcccugacccgguacggcaaguucaaggacgccgacgaggagcccaagaucgccuggcgcaaggacgacgaggggaagaugcacuuccucuucgcggacuccuucaacgagaugaucgaggaguuccggagcguccagcccgagcugcugaagcgcggcaugaaggugcccuacgacuggacccucuacuaccugcggaagaaggccaugcgcgaggccgugacgccguucgagcuggccuggcucauccuguccuucaaccagaagcggggguacuaccagcugcgcggcgaggaggagggcgaggcggacaacagcaaguccgaggaguaccucgcccagcgggucguggacgugaucgacaccggggagaagaagggcaagagcaccugguucgacaucguccuggagaacgggaugguguaccaccgccccgccgagaucaagcccgacuggaucggcaagaccaaggaguucaucgugacgacccaguucgacaaggacggcaaccccaagaaggacaaggaggggaacgucaagauguccuuccggaugccgaacgagaacgacuggaaccugcagaagaagaaggccgagaaggacaucgacgagagcggcaugaccgugggggaguacaucuacaacgcccuccugcacaaccccaagcagaagaucaagggcaagcuggugcgcgucguggagcgcaaguacuacaagaacgagcuccagaagauccuggagucccagaagcgguucaucccccagcugagcgacuccgcgcucuacgagaagugcaucaaggagcuguaccagagcaacgaggccuaccgcaacuccaucagcacccggaacgacuucacguaccuguucguggacaacaucaucuucuaccagcgcccccucaaguccaagaagucccugaucgacaacugcccguacgagagccuggccuacaccaaggacggggaggagcacaaggcccccgucaagugcaucgccaagagccacccccucuaccaggaguuccggcuguggcaguucaucagcaaccugcgcaucuaccagcggcagaagcaggucggcgacaaggugaagcucgacguggacgugaccgacgaguuccugcccaccgacgaccgccgggagucccuguucgacuaccucaacgacaagacggagaucaagcaggacgugcugcugaaggaguucuucagcaugaagaagccgaagggcaaggacuccgucuaccccuaccgcuggaacuacguggaggacaagagcuaccccugcaacgucacccgggggaagauccucgcgaagcugaaccgcgccggcaucuccgccgacuuccugagcuccaacgggaacgaggagagccucuggcacauccuguacuccguggaggacaagggcgagcugcggaaggcccuggcccgcuucgcggccaagaacgggcucgacgacgccuucaccgaggcccuggccgacaucgagcccuacaagaaggaguacggcgcguacagcgccaaggcccugaagaagcuccugccgcugaugcggcucggcaaguacuggaacuacgacaacaucgcccccgcgaccaaggcccgcaucuccaagaucaucgacggggaguacgacgagaacauccggaaccgcgugcgggagaaggccaugagccugaacuccgccagccaguuccagggccugccccucuggcuggccugcuacaucgucuacgaccgccacuccgagcgcgcggacagcgggcggugguccagccccgaggacaucgacaaguaccugagcgacuucaagcagcacucccuccgcaacccgaucguggagcaggucgugacggagacccugcggaccgugcgcgacaucuggaagcgguacggcgagaucagcgagauccacguggagcuggggcgcgagaugaagaaccccgccgacaagcgguccaagaugaaccgccggaugcucgagaacgagaacgccaacaugcgcgccaagcugcugcucaccgaguucaugaaccccgaguucggcaucgagaacguccggagcuacucccccagccagcaggagcugcugcgcaucuacgaggacggcgccaucuccaacgcggggagcgagaucgacgacgagaucuccgacaucaugagccggcucucccagguggacgugaagaagcagccgacggccagcgaggucaagcgcuacauccuguggcuggagcagaacuaccggucccccuacaccggccagaugaucccccucgccaagcuguucaccccggccuacgagaucgagcacgugaucccccagagccgcuacuucgacgacuccuucagcaacaaggugaucugcgaggccgaggucaacaagcugaaggaccggaugcucggguacgaguucaucaagcagcacaagggcgagaaggugucccugagcaugggcgggaccguggagauccugagccccgaggaguacguccgccacguggagucccaguacaagaacaacaaggcgaagaugcggaagcuccugauggacgacauccccgacgaguucaucaaccgccagcugaacgacagccgguacaucuccaagcucaucaucagccugcuguccaacaucgugcgcgaggagggcgaggaggaggccacgagcaagaacgucaucuccugcaacgggagcaucaccgaccgccucaagaaggacuggggcaucaacgacguguggaaccacaucauccugccgcgguuccgccggcugaacgagcucaccgggaccgacaaguucacgaccuccaacaaggagggccacgaggugcccgagaugccccuggagcugcagaagggcuucaacaagaagcgcaucgaccaccggcaccacgccauggacgccaucgucaucgcgugcaucacccgcgaccacgugaaccuccugaacaacgaggccgccaugagcaagaacaacgccaaccggauccagcuguccaagaagcuccgccgguacgagagcguggagaucgagaaggacgggauccgcaagcagaucuccauggccaaggaguucaagaagcccugggagggcuucaccgcggacgucgagcggacgcugcgcgacaucguggugagcuucaagcagaaccugcgggucaucaacaagaccaccaacuacuaccagcacuucaaggacgggaagaagaucuacuccccgcagagcaagggcgacuccugggccauccgcaagagcaugcacaaggagaccguguucggggagaucaacauccggcgcaucaaggaggugucccucaaggaggccaugaagcggaucaaggacaucgccgacaaggagcugcgcagcaagaucgucgagcugauggcccuccaguacaacgagaagaagaucaagcaguacuucagcgacaacaaggacgagugguccgacgugaaccccaagaagaucaagauccacuacuucaccaaggagacgaacgagcgguucuucgcgacccgcaagccccuggacaccagcuucgacaagaagaagaucaagacccagguggccgacacggccauccagaagauccugcucaaccaccuguccgcccacggcgacaaggccgagaccgcguucagccccgacggcaucgacgagaugaaccgcaacaucaucgagcugaacgacgggaaguuccaccagccgauccucaagguccggaucuacgagaaggccgacaaguacgccgugggccagcaggggaacaagaagaagaaguacguggaggccgcgaagggcaccaaccuguucuucgccaucuacgccgaggagaagaucgacgagaagaccggggacacggucaucacccgcaccuacgacuccaucccccugaacguggugaucgaccgggagaagcgcggccucagccccguccccgagaacgagaacggcgccaagccgaaguacgugcugucccccaacgaccugguguacguccccaacgaggaggagcgggagaccgggcgcaucugcgagccccucgacaaggagcggaucuacaagauggugagcuccaacaagaagcaggccuucuucaucaagagcgagguggcguccacgaucgucgacaaguucgaguucagcgcccugaacaagcaggagcgcgcccuguccggcgagaugaucaaggagaucugcaucccgaucagcaucaaccggaucggggagaucacccuccgcuga

SEQ ID NO: 2276 - RNA, 4554 nt, Artificial Sequence
  Cas9 variant
augaagaagaucgugggccuggaccucgggaccaacagcaucggcugggcccugaucaacgccuacaucaacaaggagcaccuguacgggaucgaggcgugcggcucccgcaucauccccauggacgccgccauccucgggaacuucgacaagggcaacagcaucucccagaccgccgaccggacgagcuaccgcggcauccggcgccugcgggagcgccaccuccuccggcgcgagcggcugcaccgcauccuggaccuccugggguuccugccgaagcacuacuccgacagccucaaccgguacggcaaguuccugaacgacaucgagugcaagcugcccugggucaaggacgagaccggguccuacaaguucaucuuccaggagagcuucaaggagaugcucgccaacuucaccgagcaccaccccauccugaucgcgaacaacaagaaggugcccuacgacuggaccaucuacuaccugcgcaagaaggcccucacgcagaagaucuccaaggaggagcuggccuggauccugcucaacuucaaccagaagcggggcuacuaccagcugcgcggggaggaggaggagaccccgaacaagcugguggaguacuacagccucaaggucgagaagguggaggacuccggcgagcggaagggcaaggacaccugguacaacgugcaccuggagaacgggaugaucuaccgccggaccagcaacaucccccuggacugggagggcaagacgaaggaguucaucgucaccaccgaccucgaggccgacgggucccccaagaaggacaaggagggcaacaucaagcgcagcuuccgggcgcccaaggacgacgacuggacccugaucaagaagaagacggaggccgacaucgacaagaucaagaugaccgugggcgccuacaucuacgacacccugcuccagaagccggaccagaagauccgcgggaagcuggugcggaccaucgagcgcaaguacuacaagaacgagcuguaccagauccucaagacgcaguccgaguuccacgaggagcugcgcgacaagcagcuguacaucgccugccucaacgagcuguaccccaacaacgagccccggcgcaacagcaucuccacccgggacuucugccaccuguucaucgaggacaucaucuucuaccagcgcccccucaagagcaagaagucccugaucgacaacugcccguacgaggagaaccgguacaucgacaaggagagcggcgagaucaagcacgccagcaucaagugcaucgcgaagucccacccccuguaccaggaguuccgccucuggcaguucaucgucaaccugcggaucuaccgcaaggagaccgacguggacgugacccaggagcugcuccccacggaggccgacuacgucacccuguucgaguggcugaacgagaagaaggagaucgaccagaaggccuucuucaaguacccgcccuucggguucaagaagaccaccagcaacuaccgguggaacuacguggaggacaagcccuaccccugcaacgagacgcacgcccagaucaucgcccgccucggcaaggcgcacauccccaaggccuuccuguccaaggagaaggaggagacccuguggcacauccuguacagcaucgaggacaagcaggagaucgagaaggcccuccacuccuucgccaacaagaacaaccugagcgaggaguucaucgagcaguucaagaacuucccgcccuucaagaaggaguacggguccuacagcgccaaggcgaucaagaagcugcucccccugaugcggaugggcaaguacugguccaucgagaacaucgacaacggcacccgcauccggaucaacaagaucaucgacggggaguacgacgagaacauccgcgagcgggugcgccagaaggccaucaaccugaccgacaucacgcacuuccgggcccucccccuguggcuggccugcuaccucgucuacgaccgccacagcgaggugaaggacaucgugaaguggaagaccccgaaggacaucgaccuguaccugaaguccuucaagcagcacagccuccggaaccccaucgucgagcaggucaucaccgagacccugcgcacggugcgcgacaucuggcagcaggucggccacaucgacgagauccacaucgagcuggggcgggagaugaagaaccccgccgacaagcgcgcgcggaugucccagcagaugaucaagaacgagaacaccaaccuccgcaucaaggcccugcugaccgaguuccucaaccccgaguucggcaucgagaacgugcggccguacagccccucccagcaggaccugcugcgcaucuacgaggagggggugcucaacagcauccuggagcugcccgaggacaucggcaucauccucggcaaguucaaccagaccgacacgcugaagcggccgacccgcuccgagauccugcgguacaagcucuggcuggagcagaaguaccgcagccccuacaccggggagaugaucccccuguccaagcuguucacccccgccuacgagaucgagcacaucaucccgcagagccgguacuucgacgacagccuguccaacaaggugaucugcgagagcgagaucaacaagcugaaggaccgcucccucggcuacgaguucaucaagaaccaccacggggagaagguggagcuggccuucgacaagcccgucgaggugcugagcguggaggcguacgagaagcucguccacgaguccuacagccacaaccgguccaagaugaagaagcugcugauggaggacauccccgaccaguucaucgagcgccagcucaacgacagccgguacaucuccaagguggucaagagccugcuguccaacaucgugcgcgaggagaacgagcaggaggccaucagcaagaacgugauccccugcaccggcgggaucacggaccggcucaagaaggacuggggcaucaacgacguguggaacaagaucguccugccgcgcuucauccggcugaacgagcucaccgaguccacccgcuucaccagcaucaacacgaacaacaccaugauccccuccaugccccuggagcugcagaagggcuucaacaagaagcggaucgaccaccgccaccacgccauggacgccaucaucaucgccugcgcgaaccgcaacaucgugaacuaccucaacaacgugagcgccuccaagaacaccaagaucacccggcgcgaccugcagacgcugcucugccacaaggacaagaccgacaacaacgggaacuacaagugggucaucgacaagcccugggagaccuucacccaggacacgcugaccgcccugcagaagaucaccgugagcuucaagcagaaccuccgggugaucaacaagaccacgaaccacuaccagcacuacgagaacggcaagaagaucgucagcaaccaguccaagggggacagcugggccauccgcaaguccaugcacaaggagaccgugcacggcgaggugaaccugcggaugaucaagaccgucagcuucaacgaggcccugaagaagccgcaggcgaucguggagauggaccucaagaagaagauccuggccaugcuggagcucggcuacgacaccaagcgcaucaagaacuacuucgaggagaacaaggacacguggcaggacaucaaccccuccaagaucaagguguacuacuucaccaaggagaccaaggaccgguacuucgccguccgcaagcccaucgacaccagcuucgacaagaagaagaucaaggaguccaucacggacaccgggauccagcagaucaugcugcggcaccuggagaccaaggacaacgaccccacccucgccuucagcccggacggcaucgacgagaugaaccgcaacauccugauccugaacaaggggaagaagcaccagcccaucuacaaggugcggguguacgagaaggccgagaaguucacggucggccagaaggggaacaagcgcaccaaguucguggaggcggccaagggcaccaaccucuucuucgccaucuacgagaccgaggagaucgacaaggacacgaagaaggugauccggaagcgcuccuacagcaccaucccccugaacgucgugaucgagcggcagaagcagggccuguccagcgcccccgaggacgagaacgggaaccucccgaaguacauccugucccccaacgaccugguguacguccccacccaggaggagaucaacaagggcgagguggugaugcccaucgaccgcgaccggaucuacaagauggucgacagcuccgggaucaccgcgaacuucaucccggccagcacggccaaccucaucuucgcccugcccaaggccaccgcggagaucuacugcaacggcgagaacugcauccagaacgaguacgggaucggcagcccccaguccaagaaccagaaggccaucaccggcgagauggugaaggagaucugcuucccgaucaagguggaccgccuggggaacaucauccaggucggcuccugcauccucaccaacuga

SEQ ID NO: 2277 - RNA, 4563 nt, Artificial Sequence
  Cas9 variant
augaagaagaucgugggccuggaccucgggaccaacagcaucggcugggcccugaucaacgccuacaucgacgaguacaacaaggagcaccuguacgggaucgaggcgugcggcucccgcaucauccccauggacgccgccauccucgggaacuucgacaagggcaacagcaucucccagaccgccgaccggacgagcuaccgcggcauccggcgccugcgggagcgccaccuccuccggcgcgagcggcugcaccgcauccuggaccuccugggguuccugccgaagcacuacuccgacagccucaaccgguacggcaaguuccugaacgacaucgagugcaagcugcccugggucaaggacgagaccggguccuacaaguucaucuuccaggagagcuucaaggagaugcucgccaacuucaccgagcaccaccccauccugaucgcgaacaacaagaaggugcccuacgacuggaccaucuacuaccugcgcaagaaggcccucacgcagaagaucuccaaggaggagcuggccuggauccugcucaacuucaaccagaagcggggcuacuaccagcugcgcggggaggaggaggagaccccgaacaagcugguggaguacuacagccucaaggucgagaagguggaggacuccggcgagcggaagggcaaggacaccugguacaacgugcaccuggagaacgggaugaucuaccgccggaccagcaacaucccccuggacugggagggcaagacgaaggaguucaucgucaccaccgaccucgaggccgacgggucccccaagaaggacaaggagggcaacaucaagcgcagcuuccgggcgcccaaggacgacgacuggacccugaucaagaagaagacggaggccgacaucgacaagaucaagaugaccgugggcgccuacaucuacgacacccugcuccagaagccggaccagaagauccgcgggaagcuggugcggaccaucgagcgcaaguacuacaagaacgagcuguaccagauccucaagacgcaguccgaguuccacgaggagcugcgcgacaagcagcuguacaucgccugccucaacgagcuguaccccaacaacgagccccggcgcaacagcaucuccacccgggacuucugccaccuguucaucgaggacaucaucuucuaccagcgcccccucaagagcaagaagucccugaucgacaacugcccguacgaggagaaccgguacaucgacaaggagagcggcgagaucaagcacgccagcaucaagugcaucgcgaagucccacccccuguaccaggaguuccgccucuggcaguucaucgucaaccugcggaucuaccgcaaggagaccgacguggacgugacccaggagcugcuccccacggaggccgacuacgucacccuguucgaguggcugaacgagaagaaggagaucgaccagaaggccuucuucaaguacccgcccuucggguucaagaagaccaccagcaacuaccgguggaacuacguggaggacaagcccuaccccugcaacgagacgcacgcccagaucaucgcccgccucggcaaggcgcacauccccaaggccuuccuguccaaggagaaggaggagacccuguggcacauccuguacagcaucgaggacaagcaggagaucgagaaggcccuccacuccuucgccaacaagaacaaccugagcgaggaguucaucgagcaguucaagaacuucccgcccuucaagaaggaguacggguccuacagcgccaaggcgaucaagaagcugcucccccugaugcggaugggcaaguacugguccaucgagaacaucgacaacggcacccgcauccggaucaacaagaucaucgacggggaguacgacgagaacauccgcgagcgggugcgccagaaggccaucaaccugaccgacaucacgcacuuccgggcccucccccuguggcuggccugcuaccucgucuacgaccgccacagcgaggugaaggacaucgugaaguggaagaucccgaaggacaucgaccuguaccugaaguccuucaagcagcacagccuccggaaccccaucgucgagcaggucaucaccgagacccugcgcaccgugcgcgacaucuggcagcaggucggccacaucgacgagauccacaucgagcuggggcgggagaugaagaaccccgccgacaagcgcgcgcggaugucccagcagaugaucaagaacgagaacacgaaccuccgcaucaaggcccugcugaccgaguuccucaaccccgaguucggcaucgagaacgugcggccguacagccccucccagcaggaccugcugcgcaucuacgaggagggggugcucaacagcauccuggagcugcccgaggacaucggcaucauccucggcaaguucaaccagaccgacacccugaagcggccgacgcgcuccgagauccugcgguacaagcucuggcuggagcagaaguaccgcagccccuacaccggggagaugaucccccuguccaagcuguucacccccgccuacgagaucgagcacaucaucccgcagagccgguacuucgacgacagccuguccaacaaggugaucugcgagagcgagaucaacaagcugaaggaccgcucccucggcuacgaguucaucaagaaccaccacggggagaagguggagcuggccuucgacaagcccgucgaggugcugagcguggaggcguacgagaagcucguccacgaguccuacagccacaaccgguccaagaugaagaagcugcugauggaggacauccccgaccaguucaucgagcgccagcucaacgacagccgguacaucuccaagguggucaagagccugcuguccaacaucgugcgcgaggagaacgagcaggaggccaucagcaagaacgugauccccugcaccggcgggaucaccgaccggcucaagaaggacuggggcaucaacgacguguggaacaagaucguccugccgcgcuucauccggcugaacgagcucacggaguccacccgcuucaccagcaucaacaccaacaacacgaugauccccuccaugccccuggagcugcagaagggcuucaacaagaagcggaucgaccaccgccaccacgccauggacgccaucaucaucgccugcgcgaaccgcaacaucgugaacuaccucaacaacgugagcgccuccaagaacaccaagaucacccggcgcgaccugcagacccugcucugccacaaggacaagacggacaacaacgggaacuacaagugggucaucgacaagcccugggagaccuucacccaggacacccugacggcccugcagaagaucaccgugagcuucaagcagaaccuccgggugaucaacaagaccaccaaccacuaccagcacuacgagaacggcaagaagaucgucagcaaccaguccaagggggacagcugggccauccgcaaguccaugcacaaggagacggugcacggcgaggugaaccugcggaugaucaagaccgucagcuucaacgaggcccugaagaagccgcacgcgaucguggagauggaccucaagaagaagauccuggccaugcuggagcucggcuacgacaccaagcgcaucaagaacuacuucgaggagaacaaggacaccuggcaggacaucaaccccuccaagaucaagguguacuacuucacgaaggagaccaaggaccgguacuucgccguccgcaagcccaucgacaccagcuucgacaagaagaagaucaaggaguccaucaccgacacggggauccagcagaucaugcugcggcaccuggagaccaaggacaacgaccccacccucgccuucagcccggacggcaucgacgagaugaaccgcaacauccugauccugaacaaggggaagaagcaccagcccaucuacaaggugcggguguacgagaaggccgagaaguucaccgucggccagaaggggaacaagcgcacgaaguucguggaggcggccaagggcaccaaccucuucuucgccaucuacgagaccgaggagaucgacaaggacaccaagaaggugauccggaagcgcuccuacagcacgaucccccugaacgucgugaucgagcggcagaagcagggccuguccagcgcccccgaggacgagaacgggaaccucccgaaguacauccugucccccaacgaccugguguacguccccacccaggaggagaucaacaagggcgagguggugaugcccaucgaccgcgaccggaucuacaagauggucgacagcuccgggaucaccgcgaacuucaucccggccagcaccgccaaccucaucuucgcccugcccaaggccacggcggagaucuacugcaacggcgagaacugcauccagaacgaguacgggaucggcagcccccaguccaagaaccagaaggccaucaccggcgagauggugaaggagaucugcuucccgaucaagguggaccgccuggggaacaucauccaggucggcuccugcauccucaccaacuga

SEQ ID NO: 2278 - RNA, 4563 nt, Artificial Sequence
  Cas9 variant
augaagaagaucgugggccuggaccucgggaccaacagcaucggcugggcccugaucaacgccuacaucgacgaguacaacaaggagcaccuguacgggaucgaggcgugcggcucccgcaucauccccauggacgccgccauccucgggaacuucgacaagggcaacagcaucucccagaccgccgaccggacgagcuaccgcggcauccggcgccugcgggagcgccaccuccuccggcgcgagcggcugcaccgcauccuggaccuccugggguuccugccgaagcacuacuccgacagccucaaccgguacggcaaguuccugaacgacaucgagugcaagcugcccugggucaaggacgagaccggguccuacaaguucaucuuccaggagagcuucaaggagaugcucgccaacuucaccgagcaccaccccauccugaucgcgaacaacaagaaggugcccuacgacuggaccaucuacuaccugcgcaagaaggcccucacgcagaagaucuccaaggaggagcuggccuggauccugcucaacuucaaccagaagcggggcuacuaccagcugcgcggggaggaggaggagaccccgaacaagcugguggaguacuacagccucaaggucgagaagguggaggacuccggcgagaagaagggcaaggacaccugguacaacgugcaccuggagaacgggaugaucuaccggcgcaccagcaacaucccccuggacugggagggcaagacgaaggaguucaucgucaccaccgaccucgaggccgacgggucccccaagaaggacaaggagggcaacaucaagcggagcuuccgcgcgcccaaggacgacgacuggacccugaucaagaagaagacggaggccgacaucgacaagaucaagaugaccgugggcgccuacaucuacgacacccugcuccagaagccggaccagaagauccgggggaagcuggugcgcaccaucgagcggaaguacuacaagaacgagcuguaccagauccucaagacgcaguccgaguuccacgaggagcugcgcgacaagcagcuguacaucgccugccucaacgagcuguaccccaacaacgagccccgccggaacagcaucuccacccgcgacuucugccaccuguucaucgaggacaucaucuucuaccagcggccccucaagagcaagaagucccugaucgacaacugcccguacgaggagaaccgcuacaucgacaaggagagcggcgagaucaagcacgccagcaucaagugcaucgcgaagucccacccccuguaccaggaguuccggcucuggcaguucaucgucaaccugcgcaucuaccggaaggagaccgacguggacgugacccaggagcugcuccccacggaggccgacuacgucacccuguucgaguggcugaacgagaagaaggagaucgaccagaaggccuucuucaaguacccgcccuucggguucaagaagaccaccagcaacuaccgcuggaacuacguggaggacaagcccuaccccugcaacgagacgcacgcccagaucaucacccggcucggcaaggcccacauccccaaggcguuccuguccaaggagaaggaggagacccuguggcacauccuguacagcaucgaggacaagcaggagaucgagaaggcccuccacuccuucgccaacaagaacaaccugagcgaggaguucaucgagcaguucaagaacuucccgcccuucaagaaggaguacggguccuacagcgccaaggccaucaagaagcugcucccccugaugcgcaugggcaaguacugguccaucaagaacaucgacaacggcacccggauccgcaucaacaagaucaucgacggggaguacgacgagaacauccgggagcgcgugcggcagaaggcgaucaaccugacggacaucacccacuuccgcgcccucccccuguggcuggccugcuaccucgucuacgaccggcacagcgaggugaaggacaucgugaaguggaagaccccgaaggacaucgaccuguaccugaaguccuucaagcagcacagccuccgcaaccccaucgucgagcaggucaucaccgagacgcugcggaccgugcgcgacaucuggcagcaggucggccacaucgacgagauccacaucgagcuggggcgcgagaugaagucccccgccgacaagcgggcccgcaugagccagcagaugaucaagaacgagaacaccaaccuccggaucaaggcgcugcugaccgaguuccucaaccccgaguucggcaucgagaacgugcgcccguacucccccagccagcaggaccugcugcggaucuacgaggagggggugcucaacuccauccuggagcugcccgaggacaucggcaucauccucggcaaguucaaccagacggacacccugaagcgcccgacccggagcgagauccugcgcuacaagcucuggcuggagcagaaguaccggucccccuacaccggggagaugaucccccugagcaagcuguucacccccgccuacgagaucgagcacaucaucccgcagagccgcuacuucgacgacucccugagcaacaaggugaucugcgaguccgagaucaacaagcugaaggaccggagccucggcuacgaguucaucaagaaccaccacggggagaagguggagcuggccuucgacaagcccgucgaggugcuguccguggaggccuacgagaagcucguccacgagagcuacucccacaaccgcagcaagaugaagaagcugcugauggaggacauccccgaccaguucaucgagcggcagcucaacgacucccgcuacaucagcaagguggugaagucccugcugagcaacaucguccgggaggagaacgagcaggaggcgaucuccaagaacgugauccccugcacgggcgggaucaccgaccgccucaagaaggacuggggcaucaacgacguguggaacaagaucguccugccgcgguucauccgccugaacgagcucaccgagagcacccgguucacguccaucaacaccaacaacaccaugauccccagcaugccccuggagcugcagaagggcuucaacaagaagcgcaucgaccaccggcaccacgccauggacgccaucaucaucgccugcgccaaccgcaacaucgugaacuaccucaacaacguguccgcgagcaagaacaccaagaucacgcgccgggaccugcagacccugcucugccacaaggacaagaccgacaacaacgggaacuacaagugggucaucgacaagcccugggagaccuucacgcaggacacccugaccgcccugcagaagaucaccgugagcuucaagcagaaccuccgcgugaucaacaagacgaccaaccacuaccagcacuacgagaacggcaagaagaucgucuccaaccagagcaagggggacuccugggccauccgcaagagcaugcacaaggagaccgugcacggcgaggugaaccugcggaugaucaagaccgucucccugaacgaggcccucaagaagccgcaggccaucguggagauggaccugaagaagaagauccuggcgaugcucgagcugggcuacgacacgaagcggaucaagaacuacuucgaggagaacaaggacaccuggcaggacaucaaccccagcaagaucaagguguacuacuucaccaaggagaccaaggaccgcuacuucgccguccggaagcccaucgacacguccuucgacaagaagaagaucaaggagagcaucaccgacaccgggauccagcagaucaugcugcgccaccucgagaccaaggacaacgaccccacgcuggccuucuccccggacggcaucgacgagaugaaccggaacauccugauccucaacaaggggaagaagcaccagcccaucuacaaggugcgcguguacgagaaggccgagaaguucaccgucggccagaaggggaacaagcggaccaaguucguggaggccgcgaagggcaccaaccuguucuucgccaucuacgagacggaggagaucgacaaggacaccaagaaggugauccgcaagcggagcuacuccaccaucccccugaacgucgugaucgagcgccagaagcagggccucagcuccgcccccgaggacgagaacgggaaccugccgaaguacauccugagccccaacgaccucguguacguccccacccaggaggagaucaacaagggcgagguggugaugcccaucgaccgggaccgcaucuacaagauggucgacuccagcgggaucacggccaacuucaucccggcguccaccgccaaccugaucuucgcccugcccaaggccaccgccgagaucuacugcaacggcgagaacugcauccagaacgaguacgggaucggcagcccccaguccaagaaccagaaggcgaucaccggcgagauggugaaggagaucugcuucccgaucaagguggaccggcucgggaacaucauccaggucggcagcugcauccugaccaacuga

SEQ ID NO: 2279 - RNA, 4575 nt, Artificial Sequence
  Cas9 variant
augaacaagauccugggccucgaccuggggaccaacagcaucggcugggccaucgugcagaaggacgagcagggguucuacgagaagaucaucaacgccggcucccgcaucauccccauggacgcggagaccaugaacaacuucaacaaggggaucaccaagagcccggccuccgagcggacgcgcuuccggggcgcccgccggcugaucgagcgcagccuccugcggcgcgagcggauccaccgccugcucaacaccaugaacuaccugccgccccacuacgccgagaagaucgacuucgucaaccggcugggcaaguucaucggggaggaggagcccaaguacgccuacaagguggacgagcacggcaaguuccaguucaucuucaaggaguccuucaacgagaugcucaaggacuuccaggacaagcagcccgagcuggugcugaacaacaagaagguccccuacgacuggaccaucuacuaccuccgcaagaaggcgcugaaccgggccaucagcaaggaggagcugggguggaucauccuccaguucaacaacaagcgcggcuacuaccagcugcgcggggaggaggacgagacgcugaccgagggccagaagaaggaguacuucgcccucaaggugauccggguggaggccgacuccagcuccgcgggcaagaagggggaggucugguacaacgugcagcuggagaacggcuggaucuaccggugcaagagcgagaucccccuggacugggaggggaagaucaaggaguucaucgugaccaccgaggucgacgagaacgacaacgugcucaaggacaaggagggcaaggagaagcgcaagcugaagauccccgaggccggcgacuggacgcugcucaagaagaagaccgaguccgaccuggacaagagcgggaagaccgugggcgccuacaucuacgacacccugcucuccaacccggaccagaagaucaagggcgggcugauccggacgaucgagcgcgagcuguaccggagcgagcucgagcagauccuggacaagcagaaggaguuccaccccgagcugaaggacgggacccucuacaacaagugcgucgaggagcuguaccgcuccaacgagagccgccggaucucccugagcaacuacgacuucacccgcuucaucaccgaggacgugaucuucuaccagcggccccucaaguccaagaagucccugaucgacaacugcagcuucgagcgccggaacuaccugaaccccaucacgaaggagcucgccuacgccccgaucaagugcaucgccaagagccacccccuguuccaggaguuccgccuguggcaguucaucaagaaccuccggaucaucgagcgcgagaagaucgugggcgacaagcugauguucgaccaggacgucaccaccgaguuccugcccacccagaacgacuacgugauccucuucgacuggcugaacgagcacaaggagaucgaccagaaggcgcugcucaaguaccccgccuucaaccugaagaagaacaucgacaaguaccgguggaacuacguggagaacaagagcuacccgugcaacgagacgcgcgcccugcugaaggccaagcucaacaaggcgggcaacauccccuccgacuuccuggacaacgacacccuggagagccucuggcacauccuguacuccgucgaggacaaguucgagaucgagaaggcccucaagagcuucgccaccaagaaggagcugcgggaggagcagaccguggccuucgugaagcaguucaucaacaucccgcccuucaagaaggaguacggguccuacagcgccaaggcgaucaagaagcugcugcagcucaugcgcaugggcucccgguggagcgagaacgagaucuccgacagcacgaaggaccgcauccagaagcugaucgacggggagugggacgaguccaucaagacccggacccgcgacaaggccaucaagcugaacgagaucaacgacuuccagggccucccccuguggcuggccagcuacaucgucuacgaccggcacuccgagagcggggacgugaugaagugggagacccccgaggacaucgacuacuaccucaagcacguguucaagcagcacggccugcgcaaccccaucgucgagguggucgugguggagacgcugaaggucgugaaggaccucuggaagaccuacggcuacuucaacgagauccacaucgagcuggggcgggagaugaagaaccccgccgacaagcgccgcuccaugaccaacaagaacaucgagaacgagaacaccaaccugcggaucaaggcccuccuggcggagcuggccaaccacaaggacguggagggcguccgcccguacagccccucccagcaggagauccucaagaucuacgaggagggggugcuggacaugcugacgaaggaggaccccgacuacgagagcaucagcaagaucuccaagauggcccuccccagcuccagcgagcugauccgguacaagugcuggcuggagcagaaguaccgcuccccguacaccggccaggugaucccccucgcccggcuguucaccagcgaguacgagaucgagcacaucaucccccagucccgcuacuucgacgacagcuucuccaacaaggucaucugcgagagcgcggugaacaaggacaaggacaaccugcucgccuacgaguacaucaagcagaacgaggggaagaucaucgagaucggccugggcaagaaggugaagcuguucaccgccgacuccuacacggaguucguccagagcaacuacgugggguccguggccaagaagaagaagcuccugauggacaccaucccggacagcuucaucaagcggcagcugaacgacucccgcuacaucagccgggagaucaugaagcuccuguccagcgucgugcgcgagaaggaggaggaggaggaggaggaggaggaggaggccaucagcaagaacgugaucgucugcaccggcgcgaucaccgacaagcugaagcgggagugggggcucaacgacguguggaacaccaucaucuacccccgcuucgagcggcugaaccagcugacgaacuccgacaaguucggccagugggagaacaagcagggcaagaagguguuccagaucgagaugccccucaagcugcagaagggguucaacaagaagcgcaucgaccaccggcaccacgccauggacgccaucgucaucgccugcgccacccagagccacgugaacuaccugaacaacgaguccgcgcacagcaacuccaaggagaagcgcuacuaccuccggcgcaagcugcggcgcaucgagauccuggagaagcaggagcucaaggacggcgugaccaucaccaagaagaucgaggucgccaaggaguucaacaagcccuggccgacguucacccaggacgcccacgaggugcugcagagcaucaucguguccuucaagcagaaccugcgggucgugaacaaggccaccaaccgcuacgccugcuucgugaacgggaagaaggagaucgucaagcagagcaagggcgaguccugggcgauccgcaagcccaugcacaaggacaccgugagcgccgccgugucccuccggaagaucaagacggucagccugucccaggccaucgacgacuggaccaacaucguggacaagagccugcgcaaggagaucgggcuccuguacuccaaguacggccagaacggcagcaagaacaucaucaaguacuucaaggaccgggacaacaagcacaacgggcuggacguguccaaggucaacgugcacuacuucgacaacgacuacgcggccagccgcguggcccucgaccacaaguucaacuccgccaagaucaagagcaucaccgacaccggcauccagacgauccugcugaagcaccucgagagcuacaacgagaucaacggggacaagaucaucgagcaccccgagcuggccuucuccgcggacggccuggacauccucaacgccaacaucaccaagcugaacaacgggaaguuccacaagcccaucaagaagguccggaagaccgagacccugggccucaaguucaucgugggccagacggggaacaagcgcaagaaguacguggaggccgccgacggcaccaaccuguucuucgccaucuacgucagcguggacgggauccgguccuacaagaccaucccgcugcgcgagguggcggagcggcucaaggagggccugauccccguccccgagaagaacgacaaggacgaccaccuccuguucuggcugagccccggggaccugguguacgugccguccaucgaggaggagggccgcaucgucgagaucgagaacaucaagcaggaccggaucuacaagguggugagcugcaccgagaacgagugccacugcaucccccacuucgucgccucccccaucgugaagacggacgagcucggcgccaacaacaaggcccagcgcgccuggagcggggagaugaucaaggagaccugcaucaagaucaagaugaaccggcugggccagaucgucaagaucuga

SEQ ID NO: 2280 - RNA, 4581 nt, Artificial Sequence
  Cas9 variant
augaagaagauccugggccucgaccuggggaccaacagcaucggcugggccgugcugaacgccgcggacgacaacucccucaaguacaucgaggccgccgggagccgcaucauccccauggacgccgccauccugggcgacuucgaccgggggaacuccaucagccagaccgcggagcgcacgcggauccgcggcaugcggcaccuccgcgagcgguaccuccugcgccgggcccgccugcaccggauccucaaccugcugggcuuccucccguuccacuacgcccaggacaucgaccgcuacgggaacuucuccgccgacauggagcccaagaucgcguggcggaagaaccuggagggcgagcuggaguucaucuucaucgagagcuucaacgagaugcucgaggacuuccgcaagaaccagcccgagcuggucgccgacaacaagaaggugcccuacgacugggugaucuacuaccugcggaagaaggcccucgagaagaagaucuccaaggaggagcuggccuggauccugcucaacuucaaccagaagcgcggguacuaccagcugcggggcgaggacgacgacgagagcaugaagaccgccaagacccgccaguacuucgacaagcagaucaucaagaacaucaucgacaccaaccagacguacaaggggcagcggauccugaucgucgagcuccagaacggcgacaagggcaagaucuucaagaaggagaucccggacuggaucgggcaggagaagaacaucaucgugaccguggacaucgacaaggacggcaacgacaaguacgaggaguccgggagccuguccugccgcuucaagauccccaccgacgcggagugggagagcgaguggaagcugaucaagaugaagacccagaaggaccucgacgaguccaacaagacggucggcaccuacaucuacgacagcauccugcagaaccccacccagaaggugcggggcaagcuggugcgcaccaucgagcgcaaguacuacaaggccgagcucaagcagauccuggagaagcagacggaguuccacuccgagcugcaggacaaggaccucuacaucgagugccugaacgagcuguacagcaacaacgacacccaccggaacgccaucaccgaccgcgacuucgucuaccucuucaugaacgacauccuguucuaccagcggccccugaaguccaagaagucccucaucgacaacugcccguacgagcgcaacaucuacaucgacaaggagaccggggagaucaaguacucccccaucaagugcaucgccaagagccacccccuguuccaggaguuccggcuguggaaguucaucagcuccauccgcaucuaccagcgggagagcgugguggaggucguggacaagcagcucgaccuguucuccagccaguccacgagcgugcagaagcuggucaccgacguggacgugaccgacaaguuccugaccugcgagaacgacuacgucgcccuguucgaguggcugaacaagaagaagaucaucgaccagaaggaguuccucaaguaccgccccuucggccugaagggggacaucgacaacuaccgguggaacuacguggaggacaaguccuacccgugcaacgagacgcacgcgaugauccugaccuacuucgccaaggccggcaucagcgaggacauccugaccaaggagauggaggaggcccucuggcacauccuguacuccguggaggaccgccaggagaucaccaaggcccugcggacguucgcgagcaaguaccaccucuccgacagcuucgucaagguguucuccaacaucccgcccuucaagaaggaguacgggagcuacuccgccaaggccaucaagaagcugcugagccucaugcgcaugggcaaguacugguccgaggacgccaucgacgugaacacccgggagcgcaucgacaagaucgucaccggcgaguacgacgagaagauccgggaccgcgugcgggagaagaccauccgccugaacgacauccggcacuuccgcgcccugcccgacuggcucgcgugcuacgucguguacgaccgccacagcgagacgcgggagaucaccgaguggaagucccccgaggagaucgacgaguacauccgcaacuucaagcagcacagccugcggaaccccaucguggagcaggucaucaccgagacccugcgcacggugcgggacaucuggaagcaggucgggugcaucgacgagauccacguggagcucggccgcgagaugaagaaccccgccgacaagcggaagcgcaucaccagccagaucaucgagaacgagaacgccaaccugcgggugaaggcccugcucaccgaguucgugaaccccgaguucgagaucgagaacguccgcccguacucccuggggcagcaggacauccugcggaucuacgaggacggcgugcucaacagcguggcggagguccccggggacaucgccggcauccugaagaaguucaacgagaacgacgccaagaagcgccccaccacguccgagauccugcgguacaagcucuggcuggagcagaaguaccgcagccccuacaccggcgagaugaucccgcuguccaagcuguucaccagcgccuacgagaucgagcacgugaucccccagucccgguacuucgacgacagcuucuccaacaaggugaucugcgaggccgaggucaacaagcucaaggacaacgcgcugggguacgaguucaucaagaagcaccacggcgagaagguggagcucggguucggcaagaucguggagaucuucagcgucuccguguacgagcaguucgugaaggacaacuacagccgcaaccgggggaagaugaagaagcugcugauggacgagauccccgagcaguucaucgagcgccagcucaacgacucccgguacaucagcaaggucgugaagacccugcuguccaacgugguccgcgagaaggccgagcaggaggccgugagcaagaacgugaucgucugcaccggcggcgugacggaccggcucaagaaggacugggggaucaacgacguguggaacaagaucguccugccccgcuuccugcgccucaacgagcugaccaacuccaccaacuucaccgccaagaacgccgcgggcaacgagaucccggccaugccccuggagcuccagaagggguucaacaagaagcggaucgaccaccgccaccacgccauggacgccaucgugaucgccugcgcgaaccggaacaucgugaacuaccugaacaacgagagcgccagccgcaaggccaagaucucccggcacgaccugcaggccauccucugcgacaagguccgcacggacgacaagggcaacuaccaguggcgggugaagaagcccugggacaccuucacccaggacguguacgucgcgcuggagaacaucaucgugagcuucaagcagaaccugcgcgugaucaacaagaccuccaacuacuacuggcacuacgagaacggcaagaagguccucgugaagcaggucaagggggacagcugggccauccggaagccgaugcacaaggacacgguguucggcgaggugaaccugcgcaaggugaaguccgucagccugaacgaggcccucaagaacccccaguucaucguggagaaggaccugaagcggcagcugcucucccugcugcagcagaacuucgacaucaagaagaucaagaaguacuucgaggagcacaaggacaucuggagcgacaucucccucagcaagaugaacaucuacuacuucaccaaggagaccaaggaccgcuacuucgccacccggaagccccuggacgccuccuucgacaagaagaagaucgagagcugcaucacggacaccgggauccagcagauccugcuccgccaccuggagcugaaggagaacgaccccgagcgggcguucuccccggacggcaucgacgagaugaaccgcaacaucauccagcucaacaaggggaagggccaccaccccaucgccaaggugcgggucuacgagaaggccgacaaguucgaggugggccagcgcgggaacaagagcuccaaguucguggaggccgccaagggcaccaaccuguucuucgcggucuacgagaccgaguaccccgacgagaagacgaacagcaucgugcggaagcgcaacuacgccaccaucccccugaacaucgccaucgagcgccagaagcgggggcucuccaccgccccggaggacgagaagggcaacguccccagcuucgugcugucccccaacgaccugguguaccuccccaccagcgaggacaucgucaacgggcacaucacgcagccgaucgacaagagccgcaucuacaagaugguguccagcuccggcagccagugcuucuucaucaagcacaacaucgccaacaucaucguggacaaguacgaguucagcccccugaacaagauggagcgggcgaucagcaacgagaugaucaaggagaucugcauccccgucaagguggaccgccugggcaacaucgugaagcucgggaaguccgaguga

SEQ ID NO: 2281 - RNA, 4581 nt, Artificial Sequence
  Cas9 variant
augaagaagauccugggccucgaccuggggaccaacagcaucggcugggccgugcugaacgccgcggacgacaacucccucaaguacaucgaggccgccgggagccgcaucauccccauggacgccgccauccugggcgacuucgaccgggggaacuccaucagccagaccgcggagcgcacgcggauccgcggcaugcggcaccuccgcgagcgguaccugcugcgccgggcccgccugcaccggauccucaaccugcugggcuuccucccguuccacuacgcccaggacaucgaccgcuacgggaacuucuccgccgacauggagcccaagaucgcguggugcaagaaccuggagggcgagcuggaguucaucuucaucgagagcuucaacgagaugcucgaggacuuccggaagaaccagcccgagcuggucgccgacaacaagaaggugcccuacgacugggugaucuacuaccugcgcaagaaggcccucgagaagaagaucuccaaggaggagcuggccuggauccugcucaacuucaaccagaagcggggguacuaccagcugcgcggcgaggacgacgacgagagcaugaagaccgccaagacccggcaguacuucgacaagcagaucaucaagaacaucaucgacaccaaccagacguacaaggggcagcgcauccugaucgucgagcuccagaacggcgacaagggcaagaucuucaagaaggagaucccggacuggaucgggcaggagaagaacaucaucgugaccguggacaucgacaaggacggcaacgacaaguacgaggaguccgggagccuguccugccgguucaagauccccaccgacgcggagugggagagcgaguggaagcugaucaagaugaagacccagaaggaccucgacgaguccaacaagacggucggcaccuacaucuacgacagcauccugcagaaccccacccagaaggugcgcggcaagcuggugcggaccaucgagcgcaaguacuacaaggccgagcucaagcagauccuggagaagcagacggaguuccacuccgagcugcaggacaaggaccucuacaucgagugccugaacgagcuguacagcaacaacgacacccaccgcaacgccaucaccgaccgggacuucgucuaccucuucaugaacgacauccuguucuaccagcgcccccugaaguccaagaagucccucaucgacaacugcccguacgagcggaacaucuacaucgacaaggagaccggggagaucaaguaccugcccaucaagugcaucgccaagucccacccccuguuccaggaguuccgccucuggaaguucaucagcagcauccggaucuaccagcgcgaguccgugguggaggucguggacaagcagcuggaccuguucagcucccagagcacguccgugcagaagcucgucaccgacguggacgugaccgacaaguuccugaccugcgagaacgacuacgucgcccuguucgaguggcucaacaagaagaagaucaucgaccagaaggaguuccugaaguaccggcccuucggccugaagggggacaucgacaacuaccgcuggaacuacguggaggacaagagcuacccgugcaacgagacgcacgcgaugauccugaccuacuucgccaaggccggcaucuccgaggacauccucaccaaggagauggaggaggcccuguggcacauccuguacagcguggaggaccggcaggagaucaccaaggcccuccgcacguucgcguccaaguaccaccugagcgacuccuucgucaagguguucagcaacaucccgcccuucaagaaggaguacggguccuacagcgccaaggccaucaagaagcugcucucccugaugcggaugggcaaguacuggagcgaggacgccaucgacgugaacacccgcgagcggaucgacaagaucgucaccggcgaguacgacgagaagauccgcgaccgggugcgcgagaagaccauccggcugaacgacauccgccacuuccgggcccuccccgacuggcuggcgugcuacgucguguacgaccgccacuccgagacgcgcgagaucaccgaguggaagucccccgaggagaucgacgaguacauccggaacuucaagcagcacagccugcgcaaccccaucguggagcaggucaucaccgagacccuccggacggugcgcgacaucuggaagcaggucgggugcaucgacgagauccacguggagcugggccgggagaugaagaaccccgccgacaagcgcaagcggaucaccagccagaucaucgagaacgagaacgccaaccugcgcgugaaggcccuccugaccgaguucgugaaccccgaguucgagaucgagaacguccggccguacagccugucccagcaggacauccuccgcaucuacgaggacggggugcugaacagcguggcggagguccccggcgacaucgccgggauccugaagaaguucaacgagaacgacgccaagaagcggcccaccacguccgagauccuccgcuacaagcuguggcuggagcagaaguaccggagccccuacaccggcgagaugaucccgcucuccaagcuguucaccagcgccuacgagaucgagcacgugaucccccagucccgcuacuucgacgacagcuucuccaacaaggugaucugcgaggccgaggucaacaagcugaaggacaacgcgcucggcuacgaguucaucaagaagcaccacggggagaagguggagcugggcuucgggaagaucguggagaucuucagcgucuccguguacgagcaguucgugaaggacaacuacagccggaaccgcggcaagaugaagaagcugcucauggacgagauccccgagcaguucaucgagcggcagcugaacgacucccgcuacaucagcaaggucgugaagacccugcucuccaacgugguccgggagaaggccgagcaggaggccgugagcaagaacgugaucgucugcaccgggggcgugacggaccgccugaagaaggacuggggcaucaacgacguguggaacaagaucguccugccccgguuccuccgccugaacgagcugaccaacuccaccaacuucaccgccaagaacgccgcggggaacgagaucccggccaugccccucgagcugcagaagggcuucaacaagaagcgcaucgaccaccggcaccacgccauggacgccaucgugaucgccugcgcgaaccgcaacaucgugaacuaccugaacaacgagagcgccagccggaaggccaagaucucccgccacgaccuccaggccauccugugcgacaagguccggacggacgacaaggggaacuaccaguggcgcgugaagaagcccugggacaccuucacccaggacguguacgucgcgcuggagaacaucaucgugagcuucaagcagaaccuccgggugaucaacaagaccuccaacuacuacuggcacuacgagaacggcaagaagguccuggugaagcaggucaagggcgacagcugggccauccgcaagccgaugcacaaggacacgguguucggggaggugaaccugcggaaggugaaguccgucagccucaacgaggcccugaagaacccccaguucaucguggagaaggaccugaagcgccagcuccugucccugcuccagcagaacuucgacaucaagaagaucaagaaguacuucgaggagcacaaggacaucuggagcgacaucucccugagcaagaugaacaucuacuacuucaccaaggagaccaaggaccgguacuucgccacccgcaagccccuggacgccuccuucgacaagaagaagaucgagagcugcaucacggacaccggcauccagcagauccuccugcggcaccuggagcucaaggagaacgaccccgagcgcgcguucuccccggacgggaucgacgagaugaaccggaacaucauccagcugaacaagggcaaggggcaccaccccaucgccaaggugcgcgucuacgagaaggccgacaaguucgaggugggccagcggggcaacaagagcuccaaguucguggaggccgccaaggggaccaaccuguucuucgcggucuacgagaccgaguaccccgacgagaagacgaacagcaucgugcgcaagcggaacuacgccaccaucccccucaacaucgccaucgagcgccagaagcgcggccuguccaccgccccggaggacgagaaggggaacguccccagcuucgugcugucccccaacgaccucguguaccugcccaccagcgaggacaucgucaacggccacaucacgcagccgaucgacaagagccggaucuacaagaugguguccagcuccgggagccagugcuucuucaucaagcacaacaucgccaacaucaucguggacaaguacgaguucagcccccugaacaagauggagcgcgcgaucagcaacgagaugaucaaggagaucugcauccccgucaagguggaccggcucggcaacaucgugaagcugggcaaguccgaguga

SEQ ID NO: 2282 - RNA, 4584 nt, Artificial Sequence
  Cas9 variant
auggccaagauccugggccucgaccuggggaccaacagcaucggcugggccaucguggagaaggacgggaacgacuucucccuggucgacaagggcgugcgcaucuucagcgagggggugaaguccgagaagggcaucgagagcucccgggcggccgagcgcaccggcuaccggagcgcccgcaagaucaaguaccggcgcaagcuccggaaguacgagacgcugaagguccugucccucaacgggaugugcccccugagcaucgaggagguggaggaguggaagaaguccggcuucaaggaguacccgcugaaccccgaguuccucgaguggcugcgcaccagcgacgacgagaacaucaaccccuacuucuuccgggacaaggccuccaagcagaaggugacccuguucgaggucgggcgcgccuucuaccacaucgcgcagcggcgcggcuuccucagcaaccggcuggaccaguccgccgaggggauccuggaggagcacugccccaagaucgaggcccucguggaggaccugaacagcaccgacgagauccugacgucccucaaggacuacuucuucgacaccggcauccuggacgccaacgagaagggcggguucgcgaaggaccuggacgagggcgacaagaagcucgugagccuguaccgcuccauccaggccaucgucaagaagaacgacaccgacuucgagaaggggaaggccgagaucaucgagcggcugaacaagaaggacgugcucggcaaggugaagggcaagaucaaggacaucagccaggccaugcuggaggggaacuucaagacccugggccaguacuucuucucccucuacaacaaggagcgcauccggaaccaguacacgagccgcgaggaccacuaccuggaggaguucaagaucaucugcaaguuccaggggaucggcagcaucaaccagaacgagaagcugccggagaagaaguucgaggggcucgccaaggagcuguacaaggcgaucuucuuccagcggccccugaagucccagaagggccucaucggcaagugcagcuucgagaaguccaagagccgcugcgccaucucccaccccgacuucgaggagaagcggaugugggaguaccugaacaccaucaagaucgggacccagagcgagaagguccugcgcuuccucucccaggaggagaagcugaaccugauccccaaguuccuccgcaagaaggacaacuucaacuucgaggaccuggccaaggagcugaucgagaagggcgccaccuucggguucuacaagagcuccaagcgggacagcuuccacuacugguucaacuacaagccgacggacaccguguccggcugccccgugagcgccucccucaagagcgucgugggggaggacuggaagaccaaguccuucaucuacaagaccacgaacagcaagggcaucgaggugucccgcaccgucaacuacaaggaccuguggcaccuccucagcguguccaccagcgacaucuaccuguacgaguacgcgaagaacaagcugggccucgaggacaagaacgccaaggccuucagcaagaucaagcugaagaaggacuucgggaaccugucccugaacgccaucaacaagauccuccccuacaugcgggagggccugcuguacagccacgccguguucauggcgaacaucgaguccaucgucgacgaggugaucuggaacgaccucgggcagcgcaaguacauccaggacaagaucgccgccaucaucgccaacaacaucguggacaacggccugcuggaggucgugaacgggcucaucaaggagugcaaggucgacggcgccuacuacagcaaggaggcggccgacaccuaccggaaggaccuguccaagaagcuggugagcuucuucaaguuccaccacaucgacgacggcaucaagcaggagacgauccucaacgagcuguuccccguguucaucgagcagcugaaggcccacgaguucaucaaggucaagcgccucgacgagaaggugcuggaguuccugaagggggagaaccaggacggcgagguguucugcaacaacgccaagcagcucaagaagcuguaccacccguccgacaucgaggucuucaagaagcagaucgugaaggacaaggacgggaccgagaccggccagcugauccucggcagcccccugaccuccagcaucaagaaccccauggcgaugcgggcccugcaccagcuccgcaaggugcugaacacgcugaucgucgaggagcaggucgacuccagcacccggauccacaucgagauggcccgcgagcucaacgacgccaacaagcggaaggggauccaggacuaccagaacgagaacaagaaggagcgcgagaaguaccgggacgagaucaagaagcuguaccuggccgagugcaacaaggagaucgagcccaccguggacgaccuccugcgcuaccagcuguggaucgagcaggaccggaaggagaucuacgagaacggcaacuccaucagcaucugcgacaucaucggggacaacccggcguacgacaucgagcacaccgugccccgcuccaucagccaggacaacucccagaugaacaagacgcucugcagccagaaguucaaccgggacgugaagaagcagaagaugcccuucgagcugggcaaccaccuggagauccucccccgcaucgcccacuggaaggaggaggccgacaaccugagccgggagaucgagaugaucauccgcuccaccaagaccgccgccaccaaggaggcgaaggacaagaagauccgccggcgccacuaccugacgcuccggcgcgacuaccugcaggggaaguacgaccgguucaucuggaccgagccgaaggugggcuucaagaacagccagauccccgacaccggcaucaucacccgcuacgcccaggccuaccugaaguccuacuucaaccgggucgagagcgugaagggcgggaugguggccgaguuccgcaagaucugggggauccaggaguccuaccaggagaacggcaagaaguacuucaaggagaaggaccggagcaagcacacgcaccacaccaucgacgccaucaccaucgcgugcaugaccaaggacaaguacgacguccucgcccacgccuggacccuggaggacaaggagcagaucacggaggcccgcaagaucguggcggaguccaagcccuggaagaccuucaaggaggaccugaagaagaucgaggaggggauccucgugagccacuacacccccgacaacgucaagaagcaguccaagaagaucgugcgggugcgcggccggaagcaguacgucgccgagaucgagcgcgacgugaacggcaaggccguggccaagaaggacaucagcgggaaggucaucuacaagcuggacaaggacggcaagaagcugccgcggcuccagcagggggacaccauccgcggcucccugcaccaggacagcaucuacggggccaucaagaacccccugaagacggaggagauccgguacgugauccgcaaggaccucgaguccaucaaggcgagcgacguggacaacaucgucgacgagauggugaaggagaaggugaaggaggccaucgccuccaagguccugauccugagcuccaacccccagcagaagaacaagaucgacggcaagguguggaugaacgaggagaagggcauccccaucaacaaggugcggcucuacgccaacagcgucaagaacccgcuggagaucaaggagcacuccagccugagcaagucccgccacgagcacaagcagaagguguacgggcagaacgacgagaacuucgccauggcgaucuacgagggccucgacaagaaggggaagaccgagcgggccuucgagcugaucaacuacauggacgccggcuacuacuacaagcugaagaacaagaacgagcgcaagaaggacaucaucagccucgugcccgagaagcacaucgagaccggguucaaccugcugcgcuccaacaagauccccaucauccucaagaagggccugaacgucauccuguacaagaacgagaaggaggagaucgacuucaacaacccgaacagcaucaucaagcggcucuacaagaucuccggccuggacaaggacgggaucaagcugauguacugcaucagcgccaagggcuccaccgagaacaucgccuacaugaacgacgugaucaacaagcagaagcuguucgagcucaagagcgagauggagaagcuggggcugugggacaagguguucuccgacuucaagaacgacaaccugaagaaguccgacuucuucaagaagcugaacgaccuccugaacaagcacuacuucgagaacaacgucugcgacagcaucggcagcaucaagaaggugaagaucaaggaguccggccugacgacccccaagggcggggacgugaucgacaacuucaaggacuuccccuacaucaaguucaaggucagcaacuucaacgcgcucaucgaggggaucgacuucaagaucucccccaccggcaaguucgugcagaucuga

SEQ ID NO: 2283 - RNA, 4587 nt, Artificial Sequence
  Cas9 variant
augaagaagauccugggccucgaccuggggaccaacagcaucggcugggcccugguggagcaggacuucaagaacaagcaggggaacaucaugggcauggggucccgcgucauccccaugagccaggagauccucggcgaguucgcccggggcaacaccaaguccgagacggcggagcgcacccggcugcgcagcgugcggcgccugcgggagcgccaccuccugcggcgcgagcggcugcaccgcgugcuccacauccugggguuccugccgaagcacuacgucaaccagaucgacuuccaggagcggcucggcaaguucuucgaggaguccgagcccaagcuggccuacgacaccggggacuuccuguucaagcccagcuuccucgagaugcuggaggaguucaagauccaccagcccuccuucguggagggcgacaagaaggugccguacgacuggaccaucuacuuccugcgcaagaaggcccucacggagcggaucgagaaggaggagcuggccugggucauccugagcuucaaccagaagcgcggguacuaccagcuccggggcgaggacgaggaggagaagcccaacaagcuggaggaguucuacucccugaagaucguggacaucaagguggacgagagccccaacaagaagggcgacaccugguacucccucacccuggagaacggguggaucuaccgccggagcuccaaggucccccuggacgacuggcucggcaagacccgcgacuucaucgugacgaccgacaucgacgaggaggggaacccgaagcuggacaaggagggcaaccccaagcggagcuuccgcgcccccuccgaggacgacuggggccugcgcaagaagaagaccgagaaggagauccucgacagcuccaagaccguggggcacuucaucuucgagaaccugcuggcggaccccacgcagaagaucaagggccggcucguccgcaccaucgagcggaaguucuacaaggacgagcugaagcagauccuggugagccagaaccgcuuccacccggagcucuccgacgccgacaugauggccgacugcgugcgggagcuguacaagcacaaccacagccaccagaacuuccuggccagcaaggacaucaagcaccuccuggucgacgacaucaucuucuaccagcgcccccugcggucccagaaguccaccaucgggaacugcccccucgaguucaagaccuucaagaaggacggcaucgagaucaaggugcccuacaagguggcgcccaagagccacccgcuguuccaggaguuccgccugcuccagugggucagcucccugcggaucauccgcaagagcgacgacuccgacgugacgcgggaguuccuggggacccaggacaagaccaagcagcuccuggacuaccugaugacccagagcgagauggacugcaacaagcugaugacguuccuccugacccaggagggcuacaagcgcaaggaccugaaguccgaggugggcaaguuccgguggaacuacgucuucgacagcgagaccggggaguccaagaccuaccccggcaacagcacgcgcgccgaguuccucaagcggcuggggaagguggagggcuucgacuucuccaaguacaccgaggaguucgaggagagccuguggcaccucguguacuccgucaccgacaagguggaguucgagaaggcccugcgcaaguucagccggaagaacgggaucgagaucaacuccuucgucgagaaccugaagaaguucccgcccuacaagagcgaguacgccuccuacagccucaaggccaucaagaagcugcuggcgcucaugcgcuucggcgagaacuggaaggaggacagcaucgacuccaucagcaagcaccggaucgagaagauccugaccggcgaguacgaccccgagaucaaggacaaggugcgcgagaucucccgcgccuucgacgagguggaggacuuccaggggcugcccgucugguucgccaacuacgugguguacggccggcacagcgaggccuccgagcucaucaaguggacgagcuccgacgagauggccgacuucaucaaggaguucaagcagcacagccugcgcaaccccaucgucgagcaggucgugcuggagacccuccggguggugaaggacaucugggacaaguacgggcacggccagaaggacuucuucgacgagauccacguggagcuggggcgcgagcugaagaacccggcggagcagcgggcccgccucaccacccagaucuccgccaacgagaacacgaaccugcggaucaagagccugcucgucgagcugcugcacgaccccggcguggagaacgugcgccccuacucccccaugcagcaggagauccucaagaucuacgaggagggcguccucaagagcuccuucgaggugccggacgacauccugaagaucagcaagaccgcccagcccuccagcuccgaccugaagcgguacaagcuguggcuggagcagaaguaccgcagccccuacaccgggaagaucaucccgcucaacaagcuguucacccccgccuacgagguggagcacgucaucccccagagccgguacuucgacgacuccuucagcaacaaggugaucugcgaggcggccgugaacaagcugaaggacaaccgccucggcauggaguucaucaagugcuuccacgggcagcgggucucccugggcuucggcgaggagguggagaucuucagcgaguccgccuacaaggccuucauccaggacaacuuccccaagaacccggccaagaagcgcaagcugcucauggacgagcugcccgagcagaugguggagcggcagaugaacgacacgcgcuacaucagcaaguucgucaccuccauccugagcaacaucgugcgguccgaggagaacgacaccggguucaacagcaagaacaucauccccggcaacgggaagaucaccaccgcgcucaagcaggacuggggccugaacgacguguggaacgagcugauccucccccgcuucgagcggaugaaccagcugacggggaccaccgucuucaccgccuggaacgagaaccaccagaaguuccugccgacggugccccucgaguacgccaagggcuuccagaagaagcgcaucgaccaccggcaccacgccauggacgcgcuggugaucgccugcgccacccgcgaccacgucaacuaccugaacaacgagcacgcccucggcaagaacuacaaggggaaggaggagaagcagucccgccgguucgaccugcgccagaagcugugccucaagaagaagaacggccacagccaggagcaguacgaguggaucuucuccaagcccugggacagcuucacccaggacgccaagaagaaccuggagcggaucaucguguccuucaagcagaaccugcgcgugaucaacaagaccagcaacaaguaccucuccuacaaggacgaggaggggaaccugcggcuggacagccagggcaagcccgucaaggcgcucacgcgccagaucaagggggacgccugggccauccggaaguccauccacaaggacaccgugagcggccuggugaagcugcgccgggucaagauggugaaccucagcguggcccuggacaacccggagaacauccugaacaagaagcucaagaagaagaucgccgagcuggucaagcugaacuacgacaacaagcuccugcugaaguacuuccgcgaccgggacuacauguucgacggccgcgagguguccaagcucgacguguacuacuucgaggaggggcuggcggccagccgggucucccuggacaccagcuucuccgacaagaagauccagagcaucaccgacacgggcauccgcaagauccuccuggcccaccuggccaacuaccacgggcggcucgacgagaagggcaaggugaucccgcccgagacccuggccuucacccccgaggggaucgaggagcugaacaagaacaucaagggccucaacggcgggaaguuccaccagcccaucuucaaggugcgcaccuacgagcccaagggcaacaaguuccaggucggguucaagggcaacaagaacuccaaguacguggaggcggccaaggggacgaaccuguucuucgccaucuaccugaacgacgagggcaagcggagcuacgagaccauccccuucaacguggucauggagcgccucaagcagggcgaggggcccgugccgcagaccaacgagaagggcgggaagcugcuguuccaccucucccccaacgagcugguguacguccccgagaccgacgagaacuacacgaacguggacuucaagaaccugagcaaggagcaggucgagaagaucuacaagaugguguccagcaccggcuccgagugccacuucgugcgggccgacaucagcucccucaucaagggcuacgacgcgaagaccaaggucggggagcugggcagccugaacaagcaggaggugaccaacaacgggaugacgcgcaucaaggagaagugcuggaagaucaagaucgaccgccucggcuccaucuga

SEQ ID NO: 2284 - RNA, 4587 nt, Artificial Sequence
  Cas9 variant
augaagaagauccugggcaucgaccucgggaccaacagcaucggcugggccguggucaacuccuucgacgagaaccagaacgaggagagccugaagcacaucgagugcguggggucccgcaucauccccauggacgccgcgauccugggcgacuucgacaaggggaacagcaucucccagaccgccaagcggacggaguuccgcagcgugcggcaccuccgcgagcggcaccuccugcgccgggcccgccuccacaagauccugucccugcucggcuuccugccggaccacuacguccaggaccuggacagccacggcaacuuccccgugaacguggagcccaagaucgccuggcggaaggacuccaacggggccuucgaguucaucuucaacgacagcuucgacgagaugcuccaggacuucgcgaccuaccagcccgagcugaucgccugcaacaagaaggucccguacgacuggaccaucuacuaccugcgcaagaaggcccucaccaagaagcuguccaaggaggagcugagcuggauccuccugaacuucaaccagaagcggggcuacuaccagcugcgcggggaggaggacgacgaguccgucaagagcgccaagacgcggcaguacuucgaccgccagaagaucaaguccaucguggacaccaaccagaccuacaagggccagaaggugcucaucguggagcuggaggacgggaucaagggcaagaucuucaagaaggagauccccaacugggugggccaggagaaguccaucaucgucaccaucgacaucgacaaggacgggugcgacaaguacgaggagagcggcgagcugagcugccgguucaagauccccuccgacgcggagugggagagcgaguggaagcucaucaagaugaagacgcagaaggaccuggacgccagcgggaagaccgugggcgccuacaucuacgacgccauccugcagaaccccucccagaagauccgcggcaagcucgugcggaccaucgagcgcaaguacuacaaggaggagcugaagcagauccugaagaagcaggucgaguuccacccggagcuccgggacaaggaccuguuccuggacugccucaacgagcuguaccccaacaacgacgcccaccgcaacgcgugcgccgaccgggacuucaucuaccuguucauggacgacauccucuucuaccagcgcccccucaagagcaagaagucccugaucgccgacugccccuacgagaagcacauguaccgcgacaaggagaccggggagcugaaguacagcuccgugaagugcaucgccaagagccacccgcuguuccaggaguuccggcuguggcacuucaucuccaacauccgcaucuaccagaaggagcggguggucgacguggacgccgaccagagcgcgcucuccagcgcccgcuccgcccucaagagcaagcuggaggccgacguggacgucacgaacgaguuccugaccugcgaggccgacuacgugucccuguucgaguggcugaacaacaagaaguccgugagccagaaggacuuccugaaguaccccgcguucggcaucaagaaguccggggacaacuaccgguggaacuacgucgaggacaagagcuaccccugcaacgagacccgcgcccugauccugagccaccuggagaaggccaacauccggggcgacaucuucacccgcgagcaggaggaggcccucuggcacauccuguacuccguggaggaccgguacgagaucgucaaggcccugcagagcuucgcggccaaguaccgcuucaacgacgacuucgugacgguguucagcaaguucccgcccuucaagaaggaguacggguccuacagcgccaaggccaucaagaagcuccugccccugaugcggaugggcaaguacugguccgaggcggccaucgacaucaagacccgcgagcggaucgagaagaucaucaccggcgagugcgacgacagcauccgcgagcggguccgccucaaggccauccggcugcacgacaucggggacuuccgcgcccugcccguguggcucgccugcuacguggucuacgaccggcacuccgagagcggcgacaucaccaaguggaagacgccccaggagauggacugguacauccagaacuucaagcagcacucccugcgcaacccgaucguggagcaggucaucaccgagacccugcgcguggugcgggacaucuggaagcaggucgggcgcaucgacgagauccacguggagcucggccgggagaugaagaaccccgcggacaagcgcgccaagaugaccgcccggaugaucgagaacgagaacacgaaccugcgcaucaaggccaugcugaccgaguuccucaaccccgaguucgagaucgagaacgugcggcccuacagcgccucccagcaggacauccugcgcaucuacgagaacggggugcugaacagcgucuccgagaucccggaggagaucaccggcauccucaagaaguucaacgagcgggagcagcgcaagcggcccagcaccuccgaggugcugcgcuacaagcuguggcucgagcagaaguaccggagccccuacacgggcaagaugaucccccuggggaagcuguucaccccggcguacgagaucgagcacaucaucccccagucccgcuacuucgacgacagcuucaacaacaaggugaucugcgaggccgaggucaacaagcucaagggcaaccugcugggguacgaguucaucaagaagcaccacggccggcgcguggaccucgggcugggcgagaucguggacaucuucuccgucgacgaguacgagaccuucgugaaggacuacuacagcgccaaccagcagaagaugaagaagcugcucauggacgagauccccgagcaguucaucgagcggcagcugaacgacagccgcuacaucuccaagguggucaagagccugcucuccaacaucgugcgggagcaggacgagcaggagagcaucuccaagaaccugaucgugugcaccggcggggucacggaccgccugaagaaggacuggggcaucaacgacguguggaacaagcucauccugccgcgguuccagcgccugaacaacaucaccgagaccaccgaguucacggccaagaacaugcaggggcacgagauccccgugguccccuucgaguaccagcgcggcuucaacaagaagcggaucgaccaccgccaccacgccauggacgcgaucgugaucgccugcgccggccggaacaucgugaacuaccucaacaacgagagcgcccgcaagaaggcgcagaucucccgguacgaccugcagcgccugcucugcgacaaggucaagaccgacgacaacgggaacuacaaguggauccugaagaagcccuggagcacccugacccaggacguguacgccgcccucgacaacgugaucgucuccuucaagcagaaccugcgggugaucaacaagaccaacaaccacuacgugcacuacgaggccggcaagaagaucaucgccaagcaggagaaggcgagcugggccauccgcaagccgaugcacaaggacacggucuucggggaggugaaccugcggaaggugaagaccgucucccucaacgaggccaucaagagcccccacugcaucgugcagaaggacuucaagaagaagcugcugucccuccugaagcagaacuucgacgccaaggaggugaaggccuacuucgaggagcacaaggacgucuggagcgacaucaaccuguccaagaucgagguguacuacuucaccaaggacaccaaggagcgcuucuucgcgacgcggaagccccucgacagcuccuucgaccgcaagaagaucgagagcgugaccgacaccggcauccagaagauccugcugcggcaccucgagcagaagaacggggacuccgaccuggccuucagccccgacggcaucgaggagaugaaccagaacaucguccagcugaacggcgggcgcaagcaccagccgaucgugaaggugcgggucuacgagaaggccgacaaguucgccaucggccagcaggggaacaaggccagcaaguacguggaggcggccaagggcaccaaccucuucuucgccgucuacgaggaggaggugcgcgacaagaagacgaacgccgugauguucaagcggaacuacgcguccaucccccugaacgucgccaucgaccgccagaagaaggggcugagcaccgcccccgaggacgagaacggcaacgcccccaucuucgugcucuccccgaacgaccugguguaccugcccaccgccgaggacaucaucaacgcgcggaucagcuuccccaucaacaagaaccgcaucuacaagauggucuccugcaccggcuaccagugcuucuucaucaagcaccacguggccaacgugaucgucgacaagaaggaguucagcgcccucaacaagauggagaaggccgagacgaacgagaugaucaaggacaucugcgugcccaucaagcuggaccgccuggggaacaucgugaagaucggcgucuacaaguga

SEQ ID NO: 2285 - RNA, 4587 nt, Artificial Sequence
  Cas9 variant
augaagaagauccugggccucgaccuggggaccaacagcaucggcugggccguggucaacuccuucgacgagaaccagaacgaggagagccugaagcacaucgagugcguggggucccgcaucauccccauggacgccgcgauccucggcgacuucgacaaggggaacagcaucucccagaccgccaagcggacggaguuccgcagcgugcggcaccuccgcgagcggcaccuccugcgccgggcccgccugcacaagauccugucccuccugggcuuccugccggaccacuacguccaggaccucgacagccacggcaacuuccccgugaacguggagcccaagaucgccuggcggaaggacuccaacggggccuucgaguucaucuucaacgacagcuucgacgagaugcugcaggacuucgcgaccuaccagcccgagcugaucgccugcaacaagaaggucccguacgacuggaccaucuacuaccuccgcaagaaggcccugaccaagaagcuguccaaggaggagcucagcuggauccugcugaacuucaaccagaagcggggcuacuaccagcuccgcggggaggaggacgacgaguccgucaagagcgccaagacgcggcaguacuucgaccgccagaagaucaaguccaucguggacaccaaccagaccuacaagggccagaaggugcugaucguggagcuggaggacgggaucaagggcaagaucuucaagaaggagauccccaacugggugggccaggagaaguccaucaucgucaccaucgacaucgacaaggacgggugcgacaaguacgaggaguccggcgagcucagcugccgguucaagauccccuccgacgcggagugggagagcgaguggaagcugaucaagaugaagacgcagaaggaccuggacgccagcgggaagaccgugggcgccuacaucuacgacgccauccuccagaaccccucccagaagauccgcggcaagcuggugcggaccaucgagcgcaaguacuacaaggaggagcugaagcagauccucaagaagcaggucgaguuccacccggagcugcgggacaaggaccuguuccucgacugccugaacgagcuguaccccaacaacgacgcccaccgcaacgcgugcgccgaccgggacuucaucuaccucuucauggacgacauccuguucuaccagcgcccccucaagagcaagaagucccugaucgccgacugccccuacgagaagcacauguaccgcgacaaggagaccggggagcugaaguacagcuccgugaagugcaucgccaagagccacccgcuguuccaggaguuccggcucuggcacuucaucuccaacauccgcaucuaccagaaggagcggguggucgacguggacgccugccagcccgaccugagcuccgcgcgcagcgcccugaaguccaagcucgaggccgacguggacgucacgaacgaguuccugaccugcgaggccgacuacgugagccuguucgaguggcucaacaacaagaaguccgugagccagaaggacuuccugaaguaccccgccuucggcaucaagaaguccggggacaacuaccgguggaacuacgucgaggacaagagcuaccccugcaacgagacccgcgcgcugauccugucccaccucgagaaggccaacauccggggcgacaucuucacccgcgagcaggaggaggcccuguggcacauccuguacagcguggaggaccgguacgagaucgucaaggcccuccaguccuucgccgcgaaguaccgcuucaacgacgacuucgugacgguguucagcaaguucccgcccuucaagaaggaguacgggagcuacuccgccaaggccaucaagaagcugcugccccucaugcggaugggcaaguacuggagcgaggccgcgaucgacaucaagacccgcgagcggaucgagaagaucaucaccggcgagugcgacgacuccauccgcgagcggguccgccugaaggccauccggcugcacgacaucggggacuuccgcgcccuccccguguggcuggccugcuacguggucuacgaccggcacagcgaguccggcgacaucaccaaguggaagacgccgcaggagauggacugguacauccagaacuucaagcagcacagccugcgcaaccccaucguggagcaggucaucaccgagacccuccgcguggugcgggacaucuggaagcaggucgggcgcaucgacgagauccacguggagcugggccgggagaugaagaaccccgccgacaagcgcgcgaagaugaccgcccggaugaucgagaacgagaacacgaaccugcgcaucaaggccaugcucaccgaguuccugaaccccgaguucaagaucgagaacgugcggccguacuccgccagccagcaggacauccugcgcaucuacgagaacggggugcucaacuccgucagcgagauccccgaggagaucaccggcauccugaagaaguucaacgagcgggagcagcgcaagcggcccuccaccagcgaggugcugcgcuacaagcucuggcuggagcagaaguaccggucccccuacacgggcaagaugaucccgcuggggaagcuguucacccccgccuacgagaucgagcacaucaucccccagagccgcuacuucgacgacuccuucaacaacaaggugaucugcgaggcggaggucaacaagcugaagggcaaccugcucggguacgaguucaucaagaagcaccacggccggcgcguggaccuggggcugggcgagaucguggacaucuucagcgucgacgaguacgagaccuucgugaaggacuacuacuccgccaaccagcagaagaugaagaagcuccugauggacgagaucccggagcaguucaucgagcggcagcugaacgacagccgcuacaucagcaagguggucaagucccuccugagcaacaucgugcgggagcaggacgagcaggaguccaucagcaagaaccugaucgugugcaccggcggggucacggaccgccucaagaaggacuggggcaucaacgacguguggaacaagcugauccugccccgguuccagcgccucaacaacaucaccgagaccaccgaguucacggccaagaacaugcaggggcacgagauccccgugguccccuucgaguaccagcgcggcuucaacaagaagcggaucgaccaccgccaccacgccauggacgccaucgugaucgcgugcgccggccggaacaucgugaacuaccugaacaacgaguccgcccgcaagaaggcccagaucagccgguacgaccugcagcgccuccugugcgacaaggucaagaccgacgacaacgggaacuacaaguggauccugaagaagccgugguccacccucacccaggacguguacgcggcccuggacaacgugaucgucagcuucaagcagaaccugcgggugaucaacaagaccaacaaccacuacgugcacuacgaggccggcaagaagaucaucgccaagcaggagaaggccuccugggcgauccgcaagcccaugcacaaggacacggucuucggggaggugaaccuccggaaggugaagaccgucagccugaacgaggccaucaagagcccccacugcaucgugcagaaggacuucaagaagaagcugcucagccugcugaagcagaacuucgacgccaaggaggugaaggccuacuucgaggagcacaaggacgucugguccgacaucaaccucagcaagaucgagguguacuacuucaccaaggacaccaaggagcgcuucuucgccacgcggaagccccuggacuccagcuucgaccgcaagaagaucgaguccgugaccgacaccggcauccagaagauccugcuccggcaccuggagcagaagaacggggacagcgaccuggcguucuccccggacggcaucgaggagaugaaccagaacaucguccagcucaacggcgggcgcaagcaccagcccaucgugaaggugcgggucuacgagaaggccgacaaguucgccaucggccagcaggggaacaaggccagcaaguacguggaggccgcgaagggcaccaaccuguucuucgccgucuacgaggaggaggugcgcgacaagaagacgaacgccgugauguucaagcggaacuacgccagcaucccccugaacgucgcgaucgaccgccagaagaaggggcucuccaccgcccccgaggacgagaacggcaacgccccgaucuucgugcugagccccaacgaccugguguaccuccccaccgccgaggacaucaucaacgcccggaucuccuuccccaucaacaagaaccgcaucuacaagauggucagcugcaccggcuaccagugcuucuucaucaagcaccacguggcgaacgugaucgucgacaagaaggaguucuccgcccugaacaagauggagaaggccgagacgaacgagaugaucaaggacaucugcgugccgaucaagcuggaccgccucgggaacaucgugaagaucggcgucuacaaguga

SEQ ID NO: 2286 - RNA, 4590 nt, Artificial Sequence
  Cas9 variant
augaagaagauccugggccucgaccuggggaccaacagcaucggcugggccguggucaacuccuucgacgagaaccagaacgaggagagccugaagcacaucgagugccucgggucccgcaucauccccauggacgccgcgauccugggcgacuucgacaaggggaacagcaucucccagaccgccaagcggacggaguuccgcggcgugcggcaccuccgcgagcggcaccuccugcgccgggcccgccugcacaagauccuccggcugcugggcuuccucccggaccacuacgugcaggaccuggacgggcacggcaacuuccuggucaacguggagcccaagaucgccuggcgcaaggacagcaacgggaccuucgaguucaucuucaacgacuccuucgacgagaugcuccaggacuucgccaccuaccagcccgagcugaucgcgugcaaccggaaggugcccuacgacuggaccaucuacuaccugcgcaagaaggcccucacgaagaagcugagcaaggaggagcuguccuggauccuccugaacuucaaccagaagcggggcuacuaccagcugcgcggggaggaggacgacgagagcgucaagaccgccaagacccggcaguacuucgaccgccagaagaucaaguccaucguggacaccaaccagacguacaagggccagaaggugcucaucgucgagcuggaggacggcgugaaggggaagaucuucaagaaggagaucccgaacugggugggccaggagaaguccaucaucgucaccguggacaucgacaaggacgggugcgacaaguacgaggagagcggcgagcugagcugccgguucaagauccccuccgacgccgagugggagagcgaguggaagcucaucaagaugaagacccagaaggaccuggacgcguccggcaagaccgugggggccuacaucuacgacgccauccugcagaaccccagccagaagauccgcggcaagcucguccggacgaucgagcgcaaguacuacaaggaggagcugaagcagauccugaagaagcaggucgaguuccaccccgagcuccgggacaaggaccuguuccuggacugccucaacgagcuguacccgaacaacgacgcccaccgcaacgccugcgcggaccgcgacuucaucuaccuguucauggacgacauccucuucuaccagcggccccugaaguccaagaagucccugaucgccgacugccccuacgagaagcacauguaccgcgacaaggagaccggggagcucaaguacagcagcgugaagugcaucgccaagagccacccccuguuccaggaguuccggcuguggcacuucaucuccaacauccgcaucuaccagaaggagcgggugaucgacguggacgccugccagccggaccucagcuccgcccgcagcgcgcugaaguccaagcuggaggccgacguggacgucaccaacgaguuccugaccugcgaggccgacuacgugagccuguucgaguggcugaacaacaagaaguccgugagccagaaggacuuccugaaguaccccgccuucggcaucaagaaguccggggacaacuaccgguggaacuacgucgaggacaagagcuaccccugcaacgagacgcgcgcccucauccugucccaccuggagaaggcgaacauccggggcgacaucuucacccgcgagcaggaggaggcccucuggcacauccuguacagcguggaggaccgguacgagaucgucaaggcccugcaguccuucgccgccaaguaccgcuucaacgacgacuucgugaccguguucagcaaguucccgcccuucaagaaggaguacggcuccuacagcgcgaaggccaucaagaagcuccugccccugaugcggauggggaaguacugguccgagagcgccaucgacaucaagacccgcgagcggaucgagaagaucaucacgggcgagugcgacgacagcauccgcgagcggguccgccucaaggccauccggcugcacgacaucgagcacuuccgcgcgcugcccguguggcucgccugcuacguggucuacgaccgccacuccgagagcggggacaucaugaaguggaagacgccccaggagauggacuccuacauccagaacuucaagcagcacagccugcggaacccgaucguggagcaggucaucaccgagacccugcgcguggugcgggacaucuggaagcaggucggccgcaucgacgagauccacguggagcucgggcgggagaugaagaaccccgccgacaagcgcaaggagaugaccaagcggaucaucgagaacgagaacaccaaccugcgcaucaaggccaugcugaccgaguuccucaaccccgaguucgagaucgagaacgugcggcccuacuccgccagccagcaggacauccugcgcaucuacgagaacggcgugcugaacuccgucagcgagaucccggaggagaucaccggcauccucaagaaguucaacgagcgggagcagcgcaagcggcccuccacgagcgaggugcugcgcuacaagcuguggcucgagcagaaguacugcucccccuacaccgggaagaugaucccccugggcaagcuguucaccccggcguacgagaucgagcacgugaucccccagagccgguacuucgacgacuccuucaacaacaaggucaucugcgaggccgaggugaacaagcucaaggggaaccugcugggcuacgaguucaucaagaagcaccacgggcagcgcguggaccucggccugggcgagaucgucgacaucuucagcguggacgaguacgagaccuucgugaaggacuacuacuccgggaaccagcagaagaugaagaagcugcucauggacgagauccccgagcaguucaucgagcggcagcugaacgacagccgcuacaucuccaaggucgucaagagccugcucagcaacaucgugcgggagcaggacgagcaggaguccaucagcaagaacgugaucgugugcacgggcggggugaccgaccgccugaagaaggacuggggcaucaacgacgucuggaacaagcugauccucccgcgguuccagcgccugaacaacaucaccgagaccacggaguucaccgccaagaacauggagggccacgagauccccguggugcccuucgaguaccagcgcggguucaacaagaagcggaucgaccaccgccaccacgccauggacgccaucgucaucgcgugcgccucccggaacaucgugaacuaccugaacaacgagagcgcccgcaagaaggcccggaucucccgcuacgaccuccagaagcugcugugcgacaaggugcggaccgacgacaacggcaacuacaaguggauccucaagaagcccugggggacccugacccaggacgucuacgccgcgcuggacaacgugaucgugagcuucaagcagaaccuccgcgucaucaacaagacgaagaacuacuacgugcacuacgaggccggcaagaagaccaucgccaagcaggagaagggguccagcugggccauccggaagccgaugcacaaggacaccguguucggcgaggucaaccugcgcaaggugaagaccgugucccugaacgaggcgaucaagaacccccagugcaucgucgagaaggacuucaagaagaagcuccugagccugcucaagcagaacuucgacgccaagaaggugaaggccuacuucgaggagcacaaggacgugugguccgacaucaaccugagcaagaucgaggucuacuacuucacgaaggacaccaaggagcgguucuucgccacccgcaagccccuggacuccagcuucgacaagaaggagaucgaguccgugaccgacacgggcauccagaagauccuccugcggcaccuggagcagaagaacggggaccccgaccucgccuucagcccggacggcaucgaggagaugaaccacaacaucgugcagcugaacgggggccgcaagcaccagcccaucgucaaggugcgggucuacgagaaggcggacaaguucgccaucgggcagcagggcaacaaguccagcaaguacguggaggccgccaagggcaccaaccuguucuucgccguguacgaggaggagguccgcgacaagaagaccaacgcggugaugcucaagcggcacuacgccuccaucccccugaacguggccaucgaccgccagaagaaggggcugagcaccgcccccgaggacgagaacggcaacgucccgaucuucgugcucagccccaacgaccugguguaccugcccacggccgaggacaucgcgaacgccuccaucagcuuccccaucaacaagaaccggaucuacaagauggucuccugcaccgggaaccgcugcuucuucaucaagcaccacguggccaacgugaucgucgacaagagcgaguucuccgugcucaacaagaucgagaaggccgagaccgacgagaugaucaaggagaucugcgugccgaucaagaucgaccgccugggcaacaucgucaagaucgggguguacaaguga

SEQ ID NO: 2287 - RNA, 4608 nt, Artificial Sequence
  Cas9 variant
augaacaccauccugggccucgaccuggggaccaacagcaucggcugggcccugaucaaggugcucaacgacaagacgcgccugccccuggagaucaucgaccucggggucguggugaucccgaccgaccagcggacccuggacaaguucuccaagggcgagagcaucuccaagaccgccgagcgcacgaagcagaaggggguccggaagcuguacgagcgcaagaagcuccggcgcgagcggcugcaccgcgugcugaacauccucggcuuccugcccgagcacuacagcaagaagaucgacuucaagaagcaccugggccaguucuucgggaacucccagcccaagaucagcuacguggagaacgaccacggcaagcacgaguucaucuucauggacuccuaccgggagaugcucaaggaguucagcaagcacaacaucaagaacguccccuacgacuggaccaucuacuaccugcgcaagaaggcgcugucccagaagaucagcaaggaggagcucgccugggugauccugaacuucaacaagaagcggggguacuaccaguuccgcgacgacaacgccgacgagaacaaggagaacaagaucgagaaguacuacgcccugaaggugaccaacgucaagaaggaggacgcccagaacuacaccaucacgcucgagaacggcuggaucuacaagaacaaguccaagaucagccugcuggacugggugggguccaccaaggaguucaucagcaccgagaaguucgacaacaagggcaacaucaucaagaagaagaacggcgaggacgaccggacccucaagcugguggacuccgagaaggacuggaucgcgaucaagaaguccacggaggaccgcaucgagaacuacgggaagaccgucggcaccuaccuguacgagcaccuccugaaggacccgaaccagaagcugaacggggagcucaucaacaucaucgaccggaaguucuacaagaacgagcugaagcagauccuggagaagcagaaggaguuccaccccgagcuccugaacgaggaccuguuccagaaguccaucaucgagcucuaccccaagaacagcacccgccagaaggagcugaagaacaaggaccugugcuaccuccugaucgacgacgugaucuacuaccagcgggaccugaagaagaagaacagcacgaucaacaagugcagcuucgagagccgcgaguacuaccucaacggcgagaagcagauccagaagaucaacugcaucgccaaguccaagccccuguaccaggaguuccggacccugcaguucaucaagaaccucaagguguacgagaucaucgacggccuggagaaggacaucaccagcaagcugcucccggacuucgagaccaaggagcacuucuucgaguggcugaacgacaaggagaagaucgaccagcugcagcugcucuccuacaagugcuucgaccugcacgacaacgucaagaacgaccugaucgccaaggggaucaagcgccccacggagaaggccauccggaccgagcuccuggagaaguaccgcuggaacuacagcaaggacaacgaccgcaacuuccugcucaacgagacccgguucaagauccugaaguaccugaagaagguggacaagaagcucacccugacgaacgagcagaucgagucccuguggcuccugcuguacagcgcgaaggacgagcgcgagcucaagaacggccugcagaaguucuccgagaagaacaagcugcccaagaaguucagcgacaucuucaucuccuucccgcccuucaagaaggaguacggggccuacagcgagaaggcccucaagaagcugcugucccucgugcgguucggcaaguacuggagcuucaacaagaucgacaacaacauccagaacaagaucaugaacauccugaacggggaggucgacgacuccaucagcgaccgcgugcgggagaagaccauccugcuccaggacaagaacgacuuccaggaccugccccuguggcucgccuccuacguggccuacaaccgcuucagcgaggucuccgagaucaaguacugggacagccccgacaagaucgaguuccugaagcagcacuccaucggcaaccccaucguggagaagaucaucaacgagacccugaagcucaucaaggacaucugggugauccacggcaagagcugcaagaacuucuucagcgagauccacaucgagcugucccgggagaucaagagcuccagcaagaagcgcgcgcagaucaccaacaacaacacgaagaaccagaagcugaacaaccucaucaagucccugcugaucgagauggccagcgacaccaaguacgagaacgucaccccguacucccccagccagcaggagauccucaagaucuacgacgaggggaucuacuccaaggaggagaacagcgagaagaucaaggagaucaacaagauccggaacaacaacaagaucuccaagagcgacaucaccaaguacaagcuguggcuggagcagggcuacaucucccccuacacggggaagaucaucccccucaccaagcuguucaccgccaaguaccagaaggagcacaucaucccgcagaccaaguucuucgacgacagcuucaacaacaaggugaucugcgaggccgaggucaacaagcugaaggacaacucccucgccaugaacuucaucaaggcgaagggcgggaaggccgugaagcugagcgacggcgagacggugaccauccugaaccaggaggaguacaagcagcucguccgcaccuccuucaagaagaacagcaucaagcugcggaaccugcuccuggaggagauccccgacaccuucaccaagcgccagcugaacgacacgaaguacaucagcaagcucgugcugucccugcucagcaacaucgugcgggagaagggcgagcuggaguccaccgccaagcgcaucgucagcaccaacgggcagaucaccuccauccugcggaacgacuggggccucaacaacaucuggaacaagcugaucacgccccgcuucgagcggcugaacaacaucaacaagaacaagaucuacgggaacugggagaacaagaagggcaagaacguguuccagaucaacuaccucaacgacaaccugagcacccugaacaccaagcgcaucgaccaccggcaccacgcccucgacgcccugaucguggcgugcaccacgcgcaaccacaucaacuuccugaacaaccaguacgccaagucccgcaaccagcggcacgaccuccgcgccaagcugaagcggcgcgagaccaucaccaccgaggggagcaagaagcaggucuucaaggacuucaucaagcccugggaguccuucacgcaggacgcccugaagaagcucgagaccaccaucgugaacuucaaggugaacaagcggaucaucaacaagaccaucaacugguacaagaagugggagaagcagaaggacggcacguacaagaagauccagaagaagcagaccaagggcgacgccugggcgauccgcaagccgcugcacaucgacaccaucuacgggaucgucugcaagaagcugccccucaagagcgcccuggagaacuacaagaacaucaucgacgagaaccugaagcacaagaucaaggagcucaaggaggugaacaaguucgacaacaaccagaucaucaacuucuucaaggagugcaacuucaucuucgaggacaacaacauccagaagguggaggucuacgacuucaaggacaaccgggacaagaccauccuguccagcucccgccagcugaucgacgagagcuucacgcccaagaagaucggcaaggugcucgaccccaccauccggaacauccugcugaagcaccucaacuccaccaaguacaacaacaaguucgacagcgacgggaacccgaucaagcccgagaagcuggccuucucccccgagggccugaaggaccucaacaagaacaucaagcaccugaacaacaacaaggagcaccagccgaucaagcgcgugaagcuguucgagacccucggcaacaagaucaaggucggguacacgcagcagaagaacaagaaguucgccgagaccgcgaccggcaccaaccuguuccuggggaucuacagcgacaacaacaagcgggacuucaagacgaucccccucauccuggccauccagcgcgagaaggagggccugaaccccugccccgacaccgacgagaaggggaaccagcuccuguucucccugagcccgaacgagcugguguucgugcccaacaacgaggagcggaagaaccccaaccucgucgacuucgagaaccugagcaaggaccagaucgaccgcaucuacaaguucguguccugcaccggcagcgaggccuacuucgugcccucccggaccgccaagccgaucaucgagaacgagaacggcacgaacaacaagagccagcgcaucaucgaguucaacgagaagaccuccaucaagaacgagaagaacgagcccguccugaucaagaccaucugcuggaagaucgaggugaaccggcucgggaagaucaucaaggugaucaaguga

SEQ ID NO: 2288 - RNA, 4608 nt, Artificial Sequence
  Cas9 variant
augaccaagauccugggccucgaccuggggaccaacagcaucggcugggccauccgcgacacggagaacgaggggaucaaccagauccuggacaagggcgcccggaucuucuccgagggggucaagagcgagaacggcaaggagaucucccgcgcggccgagcggaccgccuaccgcagcgcccggaagaucaaguaccgccggaagcuccgcaaguacgagacccugaaggugcuguccaucaacggcaugugcccccucagcguggaggagguggagcaguggaagaaguccggguucaaggaguacccgcugaaccccgaguuccuggacuggcuccggaccaacgaggacaagaacaucaaccccuaccuguuccgcgacaaggccagcaagcagaaggucacgcuguucgagcucggccgggcgcuguaccacaucgcccagcgccggggguuccuguccaaccgccucgaccagagcgccgagggcguguucgaggagcacaacccccagauccagaaccugaucgaggaccuggacuccagcaacaccauccucaacgagcugaaggaguacuacaucaaccuggggaucaucgacgagaccgagaaguccggcuucaagaaggaccucgacgagggcgagaagaagcucaagagccuguacaacucccugguggccaucaccaagaagaacgcgaacgacaucgagacgugcaagcaggagcugaucgcccggcugaacaagaaggaggaccucgggaaggucaagggcaagaucaaggacaucagccaggccaugcuggaccgcaacuucaagacccuggggcaguacuucuucucccucuacaacaaggagcggauccgcaaccaguacaccagccgggaggagcacuaccuggaggaguucaucaucaucugccagacccagggcaucgagggcaucaacacgaacgagaagcugccggagaagaaguucaccgggcucgccaaggaccuguaccgcgccaucuucuuccagcggccccugaagucccagaagggccucaucgggaagugcagcuucgagaagaacaagagccgcugcgcggugucccaccccgacuacgaggaguuccgcauguggagcuaccugaacaccaucaagaucggcacccaguccgagaagacgcugcgguuccucacccuggaggagaagcugaagcucgugcccaaguucuaccgcaagagcgacuucaacuucgagguccuggccaaggagcugguggagaagggggccuccuucggcuacuacaagagcuccaagaagaacgaguucuucuacugguucaacuacaagccgaccgacagcguguccgccugcgucgugagcgccucccucgagaacgcgaucggcaaggacuggaagaucaagaccuucgaguaccagacgcggaacaccgagaagaacgaggugaccaagagcgucgacuacaaggaccuguggcaccuccuguccguggccaccagcgacacguaccuguacgacuucgccaucgagaagcugaagcuggagcccaagaacgccaaggccuucuccaagaccaagcucaagaaggacuucgcgagccugucccuggccgccaucgccaagauccuccccuaccugaagcaggggcugcucuacagccacgccguguucauggcgaacaucgagaacaucgucgacgccgacaucuggaaggacgaggagcagcagaaguucauccaguccaagaucguggagcugguggacaacuacaucgucgagaaguccaagcuggagcucaucaacggccugcugaagaucuacaacaccgaggacaaggaggggcgcaagguguacuacagcaaggaggccgagucccucuucgaggccgaccugcggaagaagcuggugcccuucuacaaggcgaacaucaucaucgaggagcacgagcaggagaucaucuuccaggaccucuucccgauccugauggaccagcugaagaagcaggaguucaucaagaucggccgccucgacaagcagaucgaggccuuccuggagggggagaacgaggagggccagaucuucugcaaccacaccgacaagcugaagaagcucuaccaccccagcgacaucgaggucuucaagaagaagacgaucaaggacgaguggggcaacgagaaggugguccuggggagcccccugaccaccagcaucaagaaccccauggccaugcgggcccuccaccagcugcgcaaggugcugaacacccucaucgccaacgaccagaucgacgaggacacgcggauccacaucgagauggcgcgcgagcugaacgacgccaacaagcggaagggcauccaggacuuccagaacgagaacaagaaguuccgcgaggaggccaucaaggagaucaagaagcuguaccucgaggagugccacaaggacgugaacccgaccgaggacgacauccugcgguaccagcuguggcucgagcaggggaagugcgagaucuacgaggagggcaacaacaucuccaucugcgacaucaucgggagcaaccccuccuacgacaucgagcacaccaucccccgcagcaucucccaggacaacagccagaugaacaagacccugugcucccugaaguucaaccggagcaucaagaagcagaagaugcccgucgagcucuccaacuacaacgacauccugccgcgcaucgcccacuggaagaaggaggccgaggagcugacgcggcagaucgagaccaucagccgcuccaucaagagcgcggccaccaagguggccaaggacaagaacauccggaagcgccacuaccucacccugaagcgcgacuacauccugggcaaguacgagcgguucaccugggaggagcccaaggugggcuucaagaacucccagauccccgacacggggaucaucaccaaguacgcccaggccuaccucaagagcuacuucaagcgcgucgagagcgugaagggcggggcgguggccgaguuccggaagcuguggggcauccaggaguccuucaucgacgagaacugguggaagcacuacaaggacaaggaccgcgacaagcacacccaccacaccaucgacgccaucacgaucgccugcaugcccaaggacaaguacgaccugcucgcgcacgccuggcggcuggaggacgagcaggacaagaaggccgccaagguccugaucgagcaggccaagccguggaagaccuucaaggaggacaucgagaagaucgagaccgagauccucgugagccacuucacccccgacaacgugaagaagcaguccaagagcaucaucaagaaccgcggcaagaaggucuacgugcugaagaacgagcugcccgugaacuucaagaacaagaucgaggggaaggacuacuucaagcucaaguucgacuccaagauccuguacaagauccccaagaagaaggagaagcagacggacaccuucuacgaggagcugccgaagaacuaccucaacggcgucgaggggaaggacuacuucaagaucaacaccaccggcaagacguucuacaagauccccaucuucaaccagggggacaccauccggggcagccugcaccaggagaccaccuacggcgcgaucaagcugcccgacaucgacaucgagacgaagaagccgcuccacaccgacaagggcggguucauccugaagaaggacaucaaggggaacgagaucguguucuucgugguccgcaaggagaucuccaagaucagcgagaacgacgugcagaacaucguggacaacgucgugcggaagaagaucgagaacgccaucgccaacucccugaucaccuucaagaucgugaagaagaagaaggucgccgugaucaaggagggcgugaccaucuggaugcgcgagcccaacaucgagaaggggaucgagggcauccccaucaagaagguccggaucaucacgaacagcgugaagaaccccaucgagaucaaggugcacuccccgcucagcaagucccgccacaagcacaagcagaaggucuacggccagaacgacgagaacuacgccauggcgcuguacgagcuggacgggaagcgggaguucgagcucaucaacaacuucaaccuggccaagcugcucaagcagagccaguccuacuacccccugcacaaggagaaggagaucaagggcaagaagauccuggugcccaucgagaagcgcaacaacaaggacgugauccucaagcgggggcagcaggucguguucuacgacaagaccguggagaaccccaaggacaucagcgagaucaucgacuuccgcgagcggaucuacaucaucgagggccugaccauccagcgccagaaggacaagaagaccuccaaggucaacgaguacgggaucauccagcugcggcacuucaaggaggcccgcaagagcgaggagaucuccaaggacaacuucaagccggacggcgaguucaagaucaacgagaacaagcccacgcggaagaugaaccacaaccaguucaccgccuucguggagggcaucgacuucaaggugcuccccagcgggaaguuccagaagaucuga

SEQ ID NO: 2289 - RNA, 4614 nt, Artificial Sequence
  Cas9 variant
augaagaagauccugggccucgaccuggggaccaacagcaucggcugggcccugaccacgaacgacuucgacaccaagaaggggaccaucgagggccucgggucccgcaucauccccaugagccaggacauccugggcaaguucgacuccggcgugagccugucccagaccgcccagcggacggaguaccgcgggaagcggcgccucguccagcgguuccugcugcgccgggagcgccuccaccgggugcugcacauccuggagcuccugccgaagcaguacagcgaggcgaucgacuucgacaagaagcugggccaguucaagcccgagcgcgagcagaagaucuccuucuacaagaacgagagcgggaagaaccaguucaucuucaccaagucccaccaggagaugcucaccgaguuccagaccuacuaccccacgaucaagaacauccccuacgacuggaccaucuacuaccugcggaagaaggcccugaccgagaagaucagcaaggaggagcucgccuggauccugcugaacuucaaccagaagcgcggcuacuaccagcuccgcggggaggagaaggaggagaacaagaacaagaaggaggaguuccacacccugcuggugacggacaucaucgagcgggacaagggcaaguccggcaccugguacaacgucauccucgagaacggguggaucuacaagcgggagagcaagaucucccuggccgacuggaucggcaagaccaagagcuucaucgugaccacggaguacaacgacgacggguccgugaagcugaccaaggacaacgaggagaagcgcagcuuccgguccccgaaggaggacgacuggggccucaucaagauccgcaccgagaagaccaucaaccagagcgacaaguccgucggcgccuacaucuacgacgcgcugcugaagaaccccaaccagaagaucaagggggagcucgugcggacgaucgagcgcaaguacuacaaggacgagcugcgggagauccugaagaagcagcucgaguuccacagcgacgugcugaacgacaagauccuguacaagaagugcaucgacgagcucuacaagaacaacgacagccacaagaacuccaucaaggaccgcggcuucgacuaccuguuccuggacgacaucaucuucuaccagcgcccccucaagagcaagaccucccugaucagcgacugcucccuggaguuccggcccaucaagaacaagaacgggguccucgugaaggacaccgacggcaagcagaucgccaaggcccugaagugcaucgcccgcagcaacccgaucuuccaggaguuccggcugcuccaguucgugaagaaccugaagaucuacaagcgcggggucguggacgacguggaggucaccaacgacuaccugaaguccgagaacgacguggagaagcuguucaacuggcucaacgacaaggcggagaucaaccagaagcaguuccuggugaacuucaagcugaaggaggacaagcaccgguggaacuucgucgaggacaagggcuaccccugcaacgagacgcgcaaccaguuccucaacgccaucgccaagaucgacguggacaagagcuucuucaacaccaagaacacccaggaccuguggcacauccuguacuccgugaccgacaagaucgagaucacgaaggccaucaccaccuucgccaagcggcacaaccuccccaacgaguucaucaucaacuucagcaagaucaagcccuacaagaaggaguacggcuccuucagcgagaaggcgaucaagaagcugcugccgcucaugcgcuucggguccuacugggacgccaagaacaucgacaucaagacccuggaccggaucgacaagauccagacgggcgaguucgacgagaagauccgcaaccggguccgcgagaaggccaucgaccugcacaagaucgacgacuucaaggaccucccccuguggcuggccagcuacaucguguacgacaagcacuccgaggccagcgacguguccaaguggaagacccccgcggacaucgagaaguuccucaagcacgaguucaagcagcacagccugcggaaccccaucgucgagcaggucaucaccgagacccugcgcguggugaaggacaucuggcuccaguacggggagggcaaggagaacuucuucaacgagauccacaucgagcuggggcgggagaugaagaacgacaaggccacgcgcgagaagaucuccaagaaggugagcgagaacgagaacaccaaccugcggaucaaggccauccucaccgagcugaagaacgacggcgucagcgacauccgcccguacucccccagccagcaggagauccugaagaucuacgaggagggcguguacaacaacgagucccggaaggagaagcucgaggagguggacaagauccgcaagaacgccaagcccaccaccagcgagaucaucaaguacaagcuguggcuggagcagggguacgccucccccuacacgggcaagcucaucccgaugagcgagcuguucaccaccaaguaccagaucgagcacaucaucccccagucccgcuucuucgacgacagccuguccaacaaggucaucugcgagagcgaggugaacgagcucaaguccaacaugaccgcgcuggaguucauccugacgaacgagaaccggaucgugacccucaccgggggcgagaccgucaagaucuucacgaaggaggccuacaaccagcacaucaucagcuacuacuccaagaacaagaacaagcagaagcgccugcugaccgaggagauccccgagcaguucaucagccggcagcucaacgacaccaaguacaucuccaagaucgugaagaaccugcugagcaagaucgugcgcgaggaggacgagcaggaggucaccuccaagcacguggugagccucaacgggagcaucacgucccggaugaagcaggacuggggccugaacgacgucuggaacaccaucgugagcccccgcuucgagcggcugaacacccucaccaacuccaacgacuucggccaguucgagcugaagaaggacgccuacgggaacgagggcaagcgcguguuccagacgaccgucccggacgccaucgccaagggguucaccaagaagcggaucgaccaccgccaccacgcgcuggacgcccucgugaucgccugcgugaaccggacccacaucaacuaccugaacaaccugaacgccaaggacacggacgacaaggcggucaagcacgagcuccgcaacaagcugugcuucaagaccaagcccgacagcaacggcaacuacaagugggaguuccacaagcccugggagaaguucaccaaggaggcccaggacaagcugaacaccacgaucguguccuucaagcagaacacccgggugaucaacaagaccgucaacaaguacgugagcuacaaggacgagaacggcaaccucaacguggacgccaacgggcugccccagaagaaggucaucacccagacgaagggcgacaacugggccauccgcaagccgcugcacgccgagaccguguccgggaagguguuccucaagcggaucaagcagagccacaucaccaucgcgaacgccaucgagcaggucgagcugaucguggacaaggaggugaagaagcagcugaaggccaagaucaagcucuaccccaacaacaucgccggccugaagaagcaccugaaggccuuccccgucaugaucaacgacaaggcgaucgacaagauccagaucuacgagacccucgaggccacggccacccgcaagauccuggacaucaccuucgacgagaagaagauccagaagaucaccgacacggggauccagaagauccugcucaaccaccugaagcaggagaaguaccagaacaccguggacgagaacggcaagaagcuggccccgcacgagaucgccuucuccgagaacggccucgaggaccugaacaagaacaucaccuuccugaacgacgggaagaaccaccagcccaucaagaaggugcggaucuucgaggagggcaacaaguucccccucggggaggucggcaacaagaucaacaaguucguggagaccgcgaaggggaccaaccuguucuucgccguguacgagaacgacgacaagaagcgcaacuacaagacgauccccuucaacgaggucaucgagcggcagaagcagggccugaacgccgcccucgagaucgacgagaacggcaaccgccugcuguucacccucagcccgaacgaccugguguacaucccccuggaggacgagaucggguaccucaacggcguguacuucaagaaccugaacaaggagcagaccguccggaucuacaaguucguguccugcaccgggggcgaggggcacuucgugcccaacaacuacagcaaggagaucaucuccaacgagaacggcagcaacaacaagaacgagcgcaugcugaacuucaacaacuucaacaucaucuucgacggcaaggagaagcccgucaugaucaaguccaucugcuggaagcucgagguggaccgccuggggaaggugaucaagaucaucaaguga

SEQ ID NO: 2290 - RNA, 4617 nt, Artificial Sequence
  Cas9 variant
augaagcacauccugggccucgaccuggggaccaacagcaucggcugggcccuggugaaguccgagcaggacugcgacgacgucgagcgcaucaacgggaucgaggccgcgggcagccggaucauccccauggacgccgccgugcucggggacuucgccaagggcaacaccaagucccagacggccgaccgcaccgcggcccggggcauccgccggaugggggagcgccacaagcugcggcgcgagcggcugaaccgcgugcucgacgucaugggcuuccugccggagcacuacagcgccgcccugacccgguacgggaaguucaaggacggcgaggagugcaagaucgcguggcgcaaggacgaguccgggcaguggaccuucguguucgaggacagcuuccgggagaugcucgccgacuucguggcccaccagcccgaguggcuggccggcggccgcaagguccccuacgacuggacgaucuacuaccugcggaagaaggcccucuccaagccccugaccaagcaggagcuggcguggcuccugcugaacuucaaccagaagcgcggguacuaccagcuccggggcgaggacgagcacaccgacgacaaggggaagcugguggaguacuacgcccugaagguggucggcguggaggacaccggcgacaagaaggggaaggacacgugguucaacaucaugcucgagaacggcaugguguaccgccggccggccgccgaggcccccgacuggaucgggaagaccaaggaguucaucgucaccaccgaccuggagaaggacggcacgcccaagaaggacaaggaggggaacaucaagcgcagcuuccggaugcccaaggaggacgacuggacccugaucaagaagaagaccgagaacgacaucgaccgcuccggcaagaccgugggcgaguacaucuacgacgcgcuccuggccgacccgacgcagaagauccgcgggaagcuggugcggaccgucgagcgcaaguacuacaaggaggagcucaagaagaucaucaacagccagaagcgguucauccccgagcugaacgacaacgagcuguacggccgcugcaucuccgagcucuaccagagcaacgacgccuaccggcaguccaucagcuccugcgacuucaccuaccuguucguggacaacaucaucuucuaccagcgcccccucaagagcaagaagucccugaucgacaacugccccuacgaggagcacagcuacaccgacuccaagacgggggaggugaagaccgccccggucaagugcguggccaagagcaacccccuguuccaggaguuccggcuguggcaguucgugcagaacauccgcaucuucgagcggcagaagaagaucggcgacagcgucaagaccgacguggacgugaccggggaguucaucaaguccgcggacgacgucgugagccucuucgacuuccugaacgaccgcaaggacaucacgcaguccguccugcucggcaccuacuucaagaucaagaagcccaagggcaaggacagcgacuaccccuaccgguggaacuacguggaggacaagaccuacccgugcaacgagacccgcgcccugauccugaaggggcucaaggacgccggcaucgacgagggguuccuggacaaggacaaggaguacucccuguggcacauccucuacagcguggaggacaagcaggagaucacgaaggccauggagaaguucgccgcgaagaacucccugggcgggaaguucgccgaggucuucagcucccugccgcccuucaacaagaacuacggcagcuacuccgagaaggccaucaagaagcuccuggcccugaugcggaccggcaaguacuggagcgcggacgccaucgacaagcacacccuggagcgcaucgacaagaucaucaacggggaguacgacgaguccauccggacccgcgugcgggagaaggccaucaaccucacggacgugagccacuuccgcggccugccccuguggcucgccugcuacaucgucuacgaccggcacuccgagagcaaggacaucacgugcuggaacugccccgccgacaucgaccaguaccuggaccacuucaagcagcacucccugcgcaaccccaucguggagcaggucgugaccgagacccuccgcaccgugcgggacaucuggcgccaguacgggaagaucgacgagauccacaucgagaugggccgggacaugaagaaccccgcggacgugcgcgccaagaugagcaagcggaugaucgacaacgagaacgccaaccugcgcaucaaggccaugcuggccgaguucgcggaccccgacuucggcaucgccgggguccggccguacucccccagccagcaggagaugcuccgcaucuacgaggagggcgcccuggagagcguggacgaggugcccgacgagaucaacgagaucaucuccaaguucaaccagaccgacaucaagaagcggcccacccacggggagaucaucaaguacaagcuguggcucgagcagaaguaccagagcccguacaccggccgcaccaucucccugagccggcuguucacggacgacuaccagaucgagcacgucaucccccagucccgcuacuucgacgacagcauguccaacaaggugaucugcgaggccgaggugaaccagcucaaggaccggaugcugggguacgaguucaucaaggcccaccacggcgagaagguccugcucagcuccggcgagaccgugaccauccugaccgcggaggaguacgagcgccuggugcagcucaacuuccggaagaaccccgucaagaugaagaagcugcugauggacgacaucccggacaaguucaucgagcgccagcucaacgacagccgguacaucuccaagaagaucaagagccugcuguccaacauggugcgcgacgagggggagcaggaggacaucagcaagaacgugaucgccugcaacggcgccaucacggaccggcucaagcgcgacuggggcgucaacgacguguggaaccacaucauccugccccgguucgagcgccugaacgccgugaccggguccgaccgcuucaccaccacgagcaccaacgggcacaccauccccgacaugccccucaaccugcagaagggcuucaacaagaagcggaucgaccaccgccaccacgcgauggacgccaucgucaucgccugcaccacgcggucccacgugaaccugcucaacaacgaggccgccaugagcaagaacaacgcggugcgcuaccagcugagccggaagcugcgccgguacgaggacaccauggucacccgcaacggcgagacccggacgaucuccguggcccgcgaguuccucaagccguggcccaccuucaacgccgacguggagaaggcccugcgggggaucgucgugagcuucaagcagaaccugcgcgugaucaacaagaccgucaacaaguaccagaaguucguguacaacgaggagaagcacaucaaggagaagaaggccgugcggcaggaggagcgcaacggccggcaccuccuggcgauccgcaagcccaugcacaaggacaccgucuacggggaggugaaccugcggcgcaucaaggaggugucccucaaggacgccgucgccaaccccaaggccgugguggacaaggaccugaagaagaagcugauggccaugaucgagcucggcuacgaccugaagcagaucacgaaguacuucgaggacaacaaggacgcguggcaggacgucaaccugaagaagaucaagguguacuacuucaccaaggacaccggggaccgguacuucgccacccgcuucggcaacgaccucgugacgcuguucagcaagaucaccaaggccgacgacgccaagaagcagaucgagcgcaucaccgacaccggcauccagaagauccugaagcggcaccucgaggcgaacgggggcgacugccagaaggccuucuccgccgacgggaucgacgagaugaaccgcaacaucacgcagcugaacggcgggcggccgcacaagcccgucuacaaggugcgcaucuacgagaaggccgacaaguucgccaucggcaccaagggcaacaaggcggccaaguucguggaggccgccaaggggaccaaccuguucuucgccgucuaccucaaggaguacgaggacagcaccacgggcgagaccaucaagaagcggguguucgacaccaucccccugaagaccgucaucgaccgccugaagaacgggcagacgcccgcgccggaggagaaggacggcgccaagcuccuguucgugcugucccccaacgaccucguguaccugcccaccgaggacgucgugaagaacggcaccaucaaccggccccuggacaagcgccggaucuacaagauggugagcugcaccgggaccgagugcuacuacaucccguucaucgucgccucccccaucguggacaagguggaguucuucagccucaacaagaucggccgcgccaucacgggggagaugaucaaggagaucugcauccccaucaaggucgaccggcugggcaacaucaccgaggugaacaacgagaagaucuga

SEQ ID NO: 2291 - RNA, 4623 nt, Artificial Sequence
  Cas9 variant
augaacaagauccugggccucgaccuggggaccaacagcaucggcugggcccugguggggaccgacgaggagggcaaccccauccgcaucuacaaguccgggagccggaucaucccgaugucccaggacguccucggcaacuucgaccgcggcaacagcaucucccagacggccgagcggaccagcuaccgcggggugcggcgccugcgggagcgccaccuccugcggcgcgagcggcugcaccgcgugcugcaccucaugggcuuccugcccucccacuacgaggaggcgaucgggugggacaagggcgacaacaagaccuucgccaaguucuacagcgacaccgagcccaagcugcccuggcggaagaacgccgagcgcgagcacgaguuccucuucaacacgccguacaacgagaugcuggucgacuuccggaagaaccagccccagcuguucaagaucaagaagaacgggcaggagucccucauccccuacgacuggaccaucuacuaccugcgcaagaaggcccugagcaagcccaucuccaagaaggagcucgccuggaucauccugaacuucaaccagaagcggggcuacuaccagcugcgcggcgaggaggaggaggagaacagcaacaagcucaucgaguaccacgcgcugaccguggugaaggucaucgccgacgagccgcagaaggggaaguccgacaucugguacaacgccgagcuggagaacggcuggguguaccggcgcagcuccaagacgccccucuucgacugggagagcaaggugaaggaguucgucgugaccaccgaccugaacgccgacgggucccugaagguggacaaggagggcggcgucaagcggagcuuccgcgugcccuccgaggacgacuggaugcucgugaagaagaagaccgagagcgacaucgagaaguccgacaagaccgucgggugcuacaucuacgacacgauccugcagaaccccucccagaagauccgcggcaagcuggugcggaccaucgagcgcaaguucuacaagaaggagcucaccgagauccugaacaagcagaaggaguuccacagcgagcugcagaacaaggagcucuaccaggagugcaucaaggagcuguacccgcacaacgaggcgcacuacgacucccugcucgugaaggacuacaccgaccuguucgucaacgacaucaucuucuaccagcggccccucaagagcaagaagucccugaucagcaacugccccuacgaguaccgcguguaccggaacgacuccgggaucguggagcgcguccccaucaagugcaucgccaagagccacccgcuguaccaggaguuccggcuguggcaguucauccacaaccuccgcaucuacgagcggcagcgcgaggugaacggcaagcccgagacggacguggacaucaccgccgaguucauccccaccaccgaggaccgggucaagcuguucgacuggcugaacaacaagaaggagaucaagcaggacacgcuccugcaguccuacuucaagaucaagaagaagaagggggacgacaaguuccccuaccgcuggaacuacguggaggacaaggaguacccgugcaacgagacccgggcccugauccucagccgccugaccaagcugaaccuguccgaggacuuccucaccaaggagauggagcuggcccuguggcacauccucuacagcgucgaggacaaggaggagaucaagaaggcguucaaguccuucgcccagaagcacaaccuggacgacagcuucguggaccaguucaucaaguucccgcccuucaagaaggacuacggcuccuacagcgccaaggccaucaagaagcugcucccccugaugcggaucggcaaguacugggacgagaaggccaucuccgggaacacgcgcagccggauccuguccaucaacgagcgccucgaggacaugcggagcagcggcaagaagaucgaggacguguccgacgacgacauccccaagcagguccucaagagcuucgacaaggugaacgggguguacuccggccugaacaccuaccaggcgugcuacgccgucuacgggcgccacagcgaggccuccgagaucaccaaguggaagacgccccaggacaucgacgacuaccugaacgaguucaagcagcacagccugcgcaaccccaucguggagcaggucaucaccgagacccugcggguggugcgcgacaucuggaagaaguacggcgacuucuccgagauccacaucgagcucggccgggagaugaagaaccccgccgacaagcgcgccaagaugaccacccagaucagcgagaacgagaacacgaaccugcggaugaagucccugcucgcggagcugaagaaccacaacgacguggagaacguccgcccguacagccccucccagcaggagauccugaagaucuacgaggagggggugcucaacagcguguccgagauccccgaggagaucaucaagaucaccaagagcucccagccgagccagaccgagcugguccgguacaagcuguggcucgagcagaaguaccgcucccccuacaccggcgagaucaucccccuggggaagcuguucacgagcgccuacgagaucgagcacgugaucccccagagccgguacuucgacgacucccucagcaacaaggugaucugcgaguccgaggucaacaagcugaagggcaaccugcucggguacgaguucgugaagaaccaccacggcgugaaggucgagcugaacuucaacaagaccguggagaucuucagcaucaacgaguacgaggaguucgugaagggcaacuacgggaagaaccgcggcaagaugaagaagcugcuccuggaggacaucccgaaguccuucaucgagcggcagcugaacgacacccgcuacaucagcaaggucgugaaggggcuccuguccaacaucgugcgggaggacggcgagcaggaggccaccagcaagcacgucauccccugcaccggcggggugacgaccauccugaagcaggacuggggccucaacgacguguggaacaagaucgucacgccccgcuucgagcggaugaacgagcugaccaacaccucccuguucgggcagugggagaacaaggagggcaagcgcaucuuccggaccgaggugccccucgagcugcagaagggguucaacaagaagcgcaucgaccaccggcaccacgccauggacgccaucgugaucgcgugcgccacccgcagccacgucaccuaccugaacaacgaguccagcaaggccaacgccaaggagauccgggacggccucaagcacaagcugugcuucaaguccaagacggacgagaccggcaacuacaaguggcaguuccacaagccgugggacaccuucacccaggacgugcaggacacgcuggagaacaucgugaucagcuucaagcagaaccuccgcgucaucaacaagaccaccaaccgcuaccagaaguacgaggaggagaagaagauccugaagucccaggagaagggggacagcugggcgauccggaagccccugcacaaggacaccguguucgccaaggugucccuccagaagaucaagugcgucaagcuggccauggcccugaaggacuggaagaacaucguggacaagcagcucaagaaggagauccgccggcugauccugagcuacggcaaguucgacgccgagauccucaacaaguacuucaaggaccgcaaguacaucuucaaggacguggacaucuccaaggucgacguguacuacuucgagacggaguacguggcgacccggaagaaccuggacaccagcuucgaccgcaagagcaucgaguccaucaccgacacggggauccagaagauccugcucaaccaccugggcgucaagaacaacaaccccgagcuggccuucagcgccgaggggaucgacgagaugaaccagcggaucguggagcucaacggcggcaagcagcaccagcccaucuacaaggugcgcauguacgagccgcuggggaacaaguuccaggucggccggaucgggaacaagaaggacaaguacguggaggccgcccccggcaccaaccuguucuacgcgaucuaccaguccgaggacaagaagcgcaucuacgacaccaucccccucaacaucaucaucgagcggcagaagaaggagcuguuccccgugccggagaacaaggaggacaaggacaaccuguacaagcuccuguucuggcugagccccaacgacauggucuaccuccccaccgagaaggagugggccaaccccgaccuguucaacuucaacaacaugacgaagaaccagcgcaagaagcuguacaaguucaucgacggguccggcaccaccgccaacuucaucccgaacaccguggccaacaucaucuucagcauccccaagaaggacuccggcaaguacagcauggggaaccggaucguccagaacgaguucggcaucgggagcccccagagcaagaaccagaaggccuucacgggcgagaugaucaaggagcgcugcuggaagcucaagaucaaccggcugggggacaucaucgagugcaucaaguga

SEQ ID NO: 2292 - RNA, 4629 nt, Artificial Sequence
  Cas9 variant
auggagaagcgcauccugggccucgaccuggggaccaacagcaucggcugggcccuggugaagggggagcggcacgagaacgacaacgagaccauccucuccuacaucgaggccgcgggcagccgcauccugccccuggacgccgccgcccagggggacuucgagaagggcaacccggccaagacgcagaccuccgagcggacccgcaugcggggcaugcgccaccuccuggagcggagccugcuccgccgggagcgccugcaccggguccuggacaucauggacuuccucccgccccacuacucccagagccugacccgcuacgggaaguucaaggcggacacggagugcaagcuggccuggcggaagaccgagaccggccacuacgaguuccucuuccaggacuccuuccaggagaugcugcaggacuuccagaaccacgggaagcuggaggagaacaagaagauccccuacgacuggaccaucuacuaccuccgcaagaaggcccugacgcagcccgugagcaagcaggagcuggccuggauccuccugaacuucaaccagaagcggggcuacuaccagcgcgaggaccaggcgguggacgacaaccagaagaagcgggucgaguaccaggcccugaaggugaucuccguggaggacaccggggagaagaagggcaagaacaccugguacgacguccgccucgagaacggccugguguaccacuacagcgcccccaucaagcccgacuggaagggggagaccaaggaguucaucgugacgaccaccaucgaccagaacggcaagcccgagcuggacaaggacgggaagccgaaguacuccaugcgggcccccaaggaggacgacuacaagcuccugauggagaagaccaagaaggacaucacggacagcggcaaguccgucggcgaguacaucuacgacgcccugcucgugaacccccagcagaagauccgcgggggccuggugcggaccaucgagcgcuacuucuacaagaaggagcuggagaagauccuccugagccaggagcgcuucauccccgagcugaccgaccgggagcucuaccgccggugcgucgaggagcuguacccguccaacgacgcguaccgccaccugaucgagagccgggacaugcgcuaccuccugguggaggacauccuguucuaccagcggccccucaaguccaagaagucccugaucgacgacugccccuacgagagccgcagcuacguggaccgggagaccggggagaucaagagcucccccgucaagugcaucgcccagagccacccgcuguuccaggaguuccgccucuggcaguucauccacaaccugcggaucuaccagaacgagcgcuccguggagggcaagcugcagcucgacguggacgucacggaggaggugcugcccacccccgagagcaaggccgcccuguuccgguuccugaacgaccgcgagaacgugacccaggagauccuccugaaggaggucuucaaggggcggaagcuguccgugaaggacugccccuaccgcuggaacuacgccggcgagggcaagaaguacccgugcaacgagacccggcaccucaugcugaagcugcucaagaaggcggggaucgacacggccuuccugacccccgagaaggagcaggcccuguggcacaucauguacagcguggaggacaaggaccaguacgagaaggcccucuccaccuucgcccgcaagaacgaccugcccgacggcuucaaggagcaguucaagaaggcgcccaccuucaagaaggacuacggggccuacagccugcgggccaucaagaagcuccugccgcugaugcgcgucggcgaguacugguccgccgacugcaucgacagcgagacgaaggagcgcaucucccagaucauccgcggggagauggacgagaaggugagccagcggaugaccaagucccgggacagcuucaccgacaucucccaguuccagggccuccccgucuggcaggccugcuacgugguguacggccgccacagcgaggcgaccgagauccagcggugggagaagcccgaggacaucgacgucuaccugaaggccuucaagcagcacucccugcgcaaccccaucguggagcaggucgugcucgagacgcugcggguggugcgcgacaucuggaagaccuacgggaaggucgacgagauccacaucgagaugggccgggacaugaagaacaccgccgaggagcgcaagcggaucuucaaccgcaaccagcagaacgagaacgacaaccugcggaucaaggcccuccugaccgaguucaugaacccggacuucgagaucgagggggugcgccccuacagccccucccagcaggaggcgcugcggaucuacgaggacggcgccuggagcgggcucgacgaggagaaggaggacaagaaggagcuggaggccauccgcgagauccugggcaaguucagccaguccgacaaggccaagcggccgacgcacagcgaggugcuccgcuacaaggccuggcuggagcagcgguacuccagccccuacaccggcgaggcgaucccccuggccaagcuguucacccccgccuacgagaucgagcacgucaucccgcagucccgcuucuucgacgacagcuucuccaacaagguggugugcgaggccgaggucaacaagcucaaggaccggaugcugggguacgaguucaucaaggcccaccagggcgagguggugagccucuccgggaccggccgcugcgcgcgcauccugagccccgaggaguacgagcagcgggucaccgacugcuacaagcacaacacggccaagaugaagaagcugcucauggaggagauccccgacgacuucauccagcgccagaugaacgacucccgguacaucagcaagcuggugaagucccugcucagcaacauggugcgcgaggagggcgagcgggaggccaucuccaagcacgucaucacgugcaacgggaccaucaccgaccgccugaagaaggacuggggcgugaacgacguguggaaccacaucauccugccccgguuccagcgcaugaaggaccucaccgggcggaacgacuucgucgccgugaacagccagggccacgagaucccguccgugccgcccgagcugcagaagggguucaagaagaagcgcaucgaccaccggcaccacgccauggacgcgaucgucaucgccugcaccacccgcaaccacgugaaccugcucaacaacgaggccgccaugagcgagaacaaggcgaaccggaucgcccugagccgcaagcugcggcgcuacgagaacugcgccaucuacaagggcggcgagaccaagaacaucuccguggccaaggaguuccucaagcccugggccacguuccccgcggacgucgagcgggcccugggggacaucguggugagcuucaagcagaaccugcgcgucaucaacaaggccaccaaccacuacgagcacuacaaggacggcaagaaggugaaggugccccagaagaagggggacaugugggucgugcggaagccccuccacaaggacaccguguacgcccuggucaaccugcgcaacgugaagaccgugggccucaaggacgccauccugaugcccgaccgcaucgcgaacaaggaccugaagaagaaggucaaggagcuccuggcccagggggacgaccugaagaagaucaagaaguacuucgagacggagaaggacaccuggcaggacguggacgugaagaagaucgaggucuacuacuucuccgaggagaccgccaaccacuacuacgccacccggaagccguucgacgccaacgugaagaucgacagcgugacggacaccggcauccagaagauccuccgccggcaccuggaggagaacggcaacaaggcggacgucgccuucucccccgaggggaucgcccgcaugaacgagaacaucuuccggcugaacggcaacaagcaccaccagcccaucuacaaggugcgcguguacgagaaggccaacaaguaccccgucgggcagaccggcaacaaggcgagcaaguucguggaggccgccaaggggaccaaccucuaccuggccgucuacgaguccgaggugguggacaagaagacggccgagaucagcaagaagcgguccuacgucaucgugccgcugcgcgacgcgguggcccggcagaagcagggcguccccguggcccccgagcgcaacgaggagggcgggaagcuccuguucgugcugagccccaaggacuucgucuacgugccgaccgaggaggagcgguccaagggcgaggugcuccugccccuggacaagaaccgcaucuacaucaugauggacgccagcgacgggaucgucaacuuccuccccuacuccguggccaaccugaucuacgcgcugccgaaggaccaggccagcggcuucugcaccgacgggcggaugauccagaacgaguucggccucggcucccccaagagcaagaacgagcgcgcccugaccggggagaugaucaaggagaucugccugcccgugaaggucgaccggcucggccgcaucacggagaucaacgggaacaagguguga

SEQ ID NO: 2293 - RNA, 4644 nt, Artificial Sequence
  Cas9 variant
augaagaagauccugggccucgaccuggggaccaacagcaucggcugggcccugaccaacaacgacuucgacaacaagcucggguccaucgagggccuggggagccgcaucauccccaugucccaggacgugcugggcaaguucgacagcggcgucuccaucagccagacggccgagcggaccaaguaccgcgggacccggcgccucgugcagcgguuccugcugcgccgggagcgccuccaccggauccugaacauccuggacuuccucccgcgccacuacuccgaggcgaucgacuucgacaagaaguucggccaguucaagcccgagcgggaggagaagcugagcuucuacaagaacgaguccgggaagaaccaguuccuguuccucgagagccaccaggagauguucuccgaguucaagcugacccaccccgaccugaagcagguccccuacgacuggacgaucuacuaccuccgcaagaaggcccugacccagaagaucagcaaggaggagcuggccuggaucauccucaacuucaaccagaagcggggcuacuaccagcugcgcggggaggaggaggaggugaacaagaacaagcuggaggaguuccacacccucgugaucguggacgucaucgagcgggagaagggcaaguccggcgugugguacaacgugauccuggagaacggguggaucuacaagcgcgagagcaagaucgcccuguucgacuggaucggcaagcagaagaacuucaucgucaccacggagcucaacgacgacgggaccaucaagcugaacaaggacaacgaggagaagcgguccuuccgcagcccgaaggaggacgacuggggccugcggaagauccgcaccgagcagaccaucaaccaguccgagaaguccgugggcagcuucaucuacgacgagcuccugaagaagcccaaccagaagaucaagggggagcuggugcggacgaucgagcgcaaguucuacaaggacgagcucagcaagauccugaaggcccagaucaccuuccacuacgagauccugggcgaccgcaacaucuacaagaagugcaucgacgagcucuaccggcacaacgacagccacaagaacaacaucaaggacaagggguucgacuaccuguuccuggacgacaucaucuucuaccagcgcccccucaaguccaagaccagccugaucuccgacugcagccuggaguucguccccaucaaggacaagaagggcauccucgugaaggacuccaacgggaagcaggucgugaagccgcugaagugcaucgccaagagcaaccccaucuuccaggaguuccggcugcuccaguucgugaagaaccugaagaucuacaagaaggagaucaucaacgagaucgacgugaccaacgacuaccugaagacggaggaggaccucgucgagcuguucgacuggcugaacgacaaggcggagaucucccagaagcaguuccuggccuaccccaaguucaagcucaaggaggacaaguaccgcuggaacuucguggaggacaagaucuaccccugcaacgagacccggaaccaguuccugaacgccaucgcgaagaucgacgugaacaagagcuucuucgacgccaagaacacccaggaccuguggcacauccucuacuccgucaccgacaagacggagcuguucagcaucaacaccgagaccggcauccaguccggcgcccugagcaccuucgccaagcgccacaaccucuccaacgaguucgugagcaacuucuccaagaucaagccguacaacaaggacuacgggagcuacuccgagaaggccaucaagaagcugcugccccucaugcgguucggcagcaacuggaacaagaacaacaucgacgcgaagacgcuggcccgcaucgacaagcugcagaccggggaguucgacgagaccaugcggacccgcgugcgggagaaggccauccaccucuccaagaucacggacuuccagggccugccccuguggcucgccagcuacaucaucuacgaccgccacagcgaggccuccaacaucagcaaguggaagacccccgaggacaucgcgugguuccugaacccgaagaacaaguccggguucaagcagcacagccugcggaaccccaucgucgagcaggucaucaccgagacccuccgcguggugaaggacaucuggcagcacuacggcgagggcaaggagaacuucuucaacgagauccacaucgagcuggggcgggagaugaagaacaacgccaacgaccgcaagcggaucacggagaccaucaaccagaacgagaacaccaaccugcgcaucaaggccauccucaccgagcugaagaacgacggcaucaacgacgugcggcccuacucccccagccagcaggagauccugaagaucuacgaggagggggucuacaacuccgagauccgcaaggagaagcucgaggacaucgacaagauccgcaagaacgccaagccgacgcccagcgagaucaucaaguacaagcuguggcuggagcagggcuacaucucccccuacaccgggaagcucaucccccugagcgaccuguucaccaccaaguaccagaucgagcacaucaucccgcagucccgccucuucgacgacagccuguccaacaaggugaucugcgagagcgaggugaacgaccugaagggcaacaacaccgcccucgaguucauccugaagaacgagggccggaucguccugcucaccgggggcaagacggugaagaucuucaccaaggaggcguacaaccagcacaucaccuccuacuacaucaagaacaagagcaagcagaagcggcugcugacggaggagauccccgagaaguucaucgaccgccagcucaacgacaccaaguacaucuccaagaucgugaagaaccugcugagcaagaucguccgggaggaggacgagcaggaggugaccagcaagcacaucgugucccucaacgggagcaucaccucccgcaugaagcaggacuggggccugaacgacgucuggaacaagaucgugagcccccgguucgagcgccugaacgccaucacgaacuccaacgacuucggcaagcucgagcugaagaaggacgaguucgggaacgccggcaagcaggucuuccagaccaccgugcccgacgacaucgccaagggguucagcaagaagcggaucgaccaccgccaccacgcccuggacgcgcucgugaucgccugcaucaaccggacccacaucaacuaccugaacaaccugaacgccaaggacgagaacgacaagacgaucaagcacgagcuccgcaacaagcugugcuucaagaccaagccggacuccaacggcaacagcaagugggaguuccacaagcccugggagaacuucaccaagaagguggaggacgagcugaaccagaccaucaucuccuucaagcagaacacgcgggucaucaacaagaccgugaacaaguaccagguguggaaggaggaggacggggccaugaagaaggucaccgugaagcagaccaagggcgacaacugggcgauccgcaagcccauccacgccgagacggugagcggcaaggucuuccucaagcggaucaagcagucccacaucaccaucgccaacgccaucgagcagaucgagcugaucguggacaaggaggugcgcaagcagcugaaggccaagaucaagcaguacccgaacaacaaggagggguucaagaagcaccucaaggcguuccccaucaugaucaacggcaaggccaucgacaagguccagaucuacgagaccaucgaggccaccgccacgcgggagcgcaacaaccuggacaucaccuucgacgagaagaagaucgagaagaucaccgacaccgggauccagaagauccugcucaaccaccugaagcaggagaucuaccagaacgccaucgacgagagcggcaagaagaucgcgccccacgagguggccuucuccgagaucgggaucgacgagcugaacaagaacaucaaggugcucaacaacggcaagaaccaccagcccaucaagaagguccggaucuucgaggagagcaagcgcuucucccugggccagagcggguccaagacggacaaguacguggagaccgccaagggcaccaaccuguucuacgccaucuacgaggggaagaagggcaaccggaacuacaagaccaucccgcucaacgaggugaucgagcgccagaagcaggggcugaacagcgcccuggucacggacgagaacgagaaccgccuccuguucacccugucccccaacgaccucguguacauccccaccaacgaggagaagaagaaccugaccacgaucaacuucgacaagcugagccgggagcagaccgagcgcaucuacaaguucgugagcugcaccuccggcgagggccacuucgucagcaacaacuacuccaaggagaucaucagcaacgagaacggguccaacaacaagaacgagcggaugcucgaguucaacaacagcaacaccaucuacgacgagaaggagaagcccgugaugaucaaguccgugugcuggaagcuggaggucgaccgccugggcaagaucaagcggaucauccgcuga

SEQ ID NO: 2294 - RNA, 4677 nt, Artificial Sequence
  Cas9 variant
augaagaagauccugggccucgaccuggggaccaacagcaucggcugggcccuggugaacgucgacaagaacgggaaccccuucggcaucgaggggcucggcucccgcaucaucccgauggaccaggccacccugagcgacuucgagaagggcaacuccaagagccagacggcggagcggaccauguuccgcggggcccggcgccugcgggagcgcaagcaccuccggcgcgagcggcugcaccgcauccugaacgagcucaacuuccugcccauccacuaccgguccugcaucgacuucgugcaccgccugggcaaguucaaggccaaccacgagcccaagaucgccuggcggagcaacgaccaggacaagauggaguucaucuuccagaacuccuuccucgagaugaugagcgacuucaccaagcgccagcccgagcuggugaaggaggggaagaagaucccguacgacuggaccaucuacuuccugcggaagaaggcccucggccagcgcaucgagaaggaggagcuggcguggcugcuccugcacuucaaccagaagcggggguacuaccagcugcgcggcgaggacgagaucgacgccacgcgguccgccaagacccgcaaguacuucgaccggaagaucaucaagagcaucaucgacaccggcgaggaguacaaggggcucaagguccugaucguggagcuggacaacggcaaccaggggaagaucuucaagcaggaggugcccgacugggucggccaggagaagaacaucaucgccaccguggaccucgacaaggacggcaaggaccgcuucgacaagggggugcugucccagcgcuucagcauccccuccgacagcgagugggagacggaguggaagcugaucaagcucaagaccgaggaggaccuggaggcgucccagaagaccgucggcaccuacaucuacgacagccugcucaagaaccccaaccagaagaucaaggggaagcuggugcggacgaucgagcgcaaguacuaccgggacgagcugcgcgccauccucaacaagcagcgggaguuccacccggagcugaacgacaagaagcuguaccagcacugcaucuucucccucuacccccagaacgaggccuuccgcaacagcaucgccaacaaggacuucaccuaccuguuccuggaggacaucaucuucuaccagcggccccucaaguccaagaaguccaccaucaacaacugcgccuacgaggugcgccgguacauggacaaggagaccaaggagcugaaggaggucccccugaagugcaucgccaagagccacccgaucuuccaggaguuccgccucuggcaguucaucagcaaccugcggaucuacaagaaggacaucacggacaucgacgugaccaacgacuuccugcacagccaggacgacuacgcgaaccucuucgaguggcugaacaacaagaacgagaucgaccagaaggccuuccugaaguaccccgccuucggcuucaagaaggacgccgugaacuaccgcuggaacuacgucgaggacaaguccuaccccugcaacaagacccggagcgcgauccucuccaagcuggacaagcacgagcaggaguuccugaccaaggagcuggagcucaagaucuggcagcugcuguacagcgugaacuccaaggaggagaucgacaaggcccucaacgugaacagccccaagaucaacaacaagaucuccaucgaccacacggggauccugcacgagcucaagagcuccagccucuccgacaucagcauccagcgccugaaggccaucaacuucgaggagaaggacuacggcuccuacagcuacaaggccaucaagaagcugcucgcccugaugcggcagggcaaguacuucgacaacaccgcgaucaccgacgccaccaaggcccgcaucaacuccaucuucgaccggcuggagagcaucuccuucgacccggagcgcaucaacagcaucagcgacgacgacauccccaagcagauccucaaguccuucaucaagcugaaccggacguacgggggcuucaacaccuaccaggccugcuacgccgucuacgggcgccacagcgaggcgaaggagaucgccaagugggagaagcccgaggacaucgaccaguaccuggccaaguucaagcagcacucccuccgcaaccccaucguggagcagaucaucaccgagacccugcgggugguccgcgacaucuggaagaagcacgccuacaagacgaucaacaaggacaaccagggcaacaacugcgagagcgaguccgagcugaccgagauccacaucgagcucgggcgggacaugaagaacaacaagagcgagcgccugcggaucucccgcaucaacagcgagaacgagaacaccaaccugcggauccgcaagcuccugaucgaguucaacgacccggaguucggcguggagaacgugcggccccacucccccagccagcaggagauccugcgcaucuacgaggacggcguccucaaguccgggguggagauccccgaguacgucgacaacaucaucaagaaguucaaggagaccgacgugaagaagcagccgagcaaguccgaggugcugcgguacaagcuguggcucgagcagaaguaccgcagccccuacacgaacgaggucaucccccugggcaagcuguucaccaacgacuaccagaucgagcacaucaucccccagucccgguacuucgacgacagcuucuccaacaaggugaucugcgaggcggaggugaaccagcucaaggagaacgagcuggggugcgaguucaucaugaacaacggcgggcgcaucgucgagcugagcuucggcaagaccgugcggauccucgacuucgaggccuacgagcaguucgugcagcagaacuacgccggcaaccgcccgaagcugcggaaccugcucaugaccgagauccccaacgacuucaucgaccgccagcugaacgacagccgguacaucuccaaggucgugaaggggcugcucagcaacaucgugcgcgaggacggcgaggccgaguccacgagcaagaaccugaucuccugcaccgggggcgucaccgcccggcugaagauggacuggggccucaacgacguguggaacaaccugaucuacccccgcuucgagcgccugaacgagcucaccaacagcaaccaguucggguacugggacaagaaggacggcaagaacguguuccagacccaggucccgauggacauccagaagggguucaacaagaagcggaucgaccaccgccaccacgcgcuggacgcccuggugaucgccugcgccacgcggucccacaucaacuaccucaacaacgagagcgccaaguccaacagcaaggagucccgcuacgaccugcggcgcaagcugcggcgccucgaggugauccagaaggaguacaccaucaacggccggaaggagauccgcaacaucgaggucgcgaaggaguucuacaagcccuggaacagcuucacccaggacgcccaguccgcccuggagaacaucguggugagcuucaagcagaaccugcgggucaucaacaagaccacgaacuacuuccuccgcuucaacaaggaggggaagaagaucuucgagacccagaccuccggcagcaacugggccauccggaagccccugcacaaggacaccgccuucggccuggugaaccucaagcgcacgaagaccgugucccuggcgaacgccauccuggacuacgaccagaucgucaaccggaagcucuggaccaagaucaaggagcugaucagcaucggguacgacaacaagcgcauccugaaguacuucaccgacgacaaggagaacuggaacgagaucaucuccagcggcaucgagguguucuacuacacggacaacuucgagaagcaggucgccacccggaagccccucgacaccagcuucaccgaguccaagaucaucaacagcaucacggaccuggggauccacaagauccugcucgcccaccuccgcgcgaacgagggcaacccgaacaucgccuucucccccgaggggaucgagaccaugaaccggcacaucugcgagcugaacggcggcaaguuccaccaccccaucuacaaggugcgcgugcacgagccccugggguacaaguucaaggugggcgacaaggggaaccgcagcaccaaguacgucgaggccgccaagggcaccaaccuguucuucgggaucuacaucaacucccagggcauccggagcuacgagacgaucccgcugaacguggccaucgagcgccagaagcagggccucucccccgugcccgacaacaacgagcugggggagcggcugcuguucuggcugagccccaacgaccuggucuaccucccgaccuccgacgagguggagagcggcaucugcugcaacaagcuggggaucgaccgcaucuacaagaugguguccugcaccggcuacgucggggacuucauccccgcgcacaucgccaaccccaucauccagacccuggagcucggcagcaacaacaaggcccagcgggccuggacgggcgagaugaucaaggagaucugcauccccgugaagguggaccgcauggggaacaucgucgagaucuucaaccggaacaagaacuga

SEQ ID NO: 2295 - RNA, 4695 nt, Artificial Sequence
  Cas9 variant
auggccaagauccugggccucgaccuggggaccaacagcaucggcugggccaucguggacgacaagaacuccaagauccuggacaccgggguccgcaucuuccccgagggcgugguggcgaagacgaucgggagcggcgacaaggaggaguccaagaacgccaagcggcgcgagagccggcagacccgccggggcuucuaccgcaagcggcuccgcaagaucaagcugcugcggacccucaucaacuucaagaugugcccgcuggagcacuucgagcuggacgucugguccaagugggacaagaucaagaagaaggaggggcgcauggcccccgagcuguuccugcccgagaacagcgccuacaaccuguggcucaagcagaaccccuacauccugcgggacaaggcccuguccaaggaccucacccugacggaguucggccgcgugcuguaccaccucauccagcggcgcggguuccugagcaaccggaagggcaaggacgacgggaagaucuacggcggcaaggaggggaucgugggcaucgacaagaccaacgagcagaucaagaacuccacccuggggaaguuccucuucaagauccugccgaaggagggcgagcccuucaagaucaucgaggacgagcugggcaacgagcuccgcguccggagccgcuacacccugcgggacauguacaucgcggaguucgaggccaucuggaaccgccaggccaagcaccuggggcucgacaacaucuacuacuccaacgugaagaacgugcugcugaagggcagccucaagaacaagaagaacgagcggaagaucaaccaccugaagaagaucaaggggaacggcaacaucgagaucaucacgcugaacaacaaccucuccaagaacgagaagcccaaguaccugcugaagaucgccaccaagcucccccugaaggaguuccuggcggggcgcaucgagaaggacgaggacggcaagaucaaguucaagagcaacgaguccguccucuucuggcagcgcccgcugcggagccagaagaagcugcucgccaagugccgcuucgagcccgaccugaaggacgacaacggcaaguucauccagaaggggaagacccccugccaccugucccacccccucuacgaggaguaccgggccuaccaguacgugaacaacaucgaguacggcaagaagcagcgccuggaggagagccagcggaagcaggucaucgaccugaucaacuccaaggacgggaacuucaaguucagcgagaucaagaagaagcucaagcugagcuacgagaccuucaacuacuccgacgacagcuccgugaacggcaacuacaugaucaagaaccugaacagcaucuucccgaaggagauccuggagaaggaguucguggugaacgucaacaaggaggacaucaucgaguacggguacgagcgcaucuggcaccucuuccacuucugcgaggacaacgacgugcugaucaagaagcugcaggacaacuucgaccucuccgagaacgacaucgagaagaucagcaagaucaaccugaaggagggcuacuccaacgugagccugaaggccaucaagaacauccuccccuaccugaaggagggcaagcugcucuccgacgccgucauccucgggggcgugcggaacguguucgggaagaaguggcacgaguucaucgacuuccacgagaagaucgagaaggacauccuguacaucaaccaccagaaguccaacaaggagggcgaggcgaucgagaagaucaagaaguaccucaucgacuacaaguucggguucacggagaacgacaaccgcuucaagaagcuguaccaccacagccaggacgucguggaggugaagcugcagaagaagaucggccccgucgaggaccuccggaaccccaucgugcagcagggcgucaacgaggugcgccggcuggugaacgagcugcucgacguccacgggaaguucgaccaggugcgcguggagcugggccgggaccugaagaacaacaagagcaagcgcgaggagaucggguacaagauccgggagaacaccgccaagaacgagaaggccaaggagcuccugaucgaguacggccugcgccagucccgggacaacguccagaaggugcuccuguuccaggagaugcuggaccgcggcaccguggccgucugcccguacaccaacaagacgaucaacaucagcgacgugcucgggaacgagaacaagaugcagaucgagcacaucauccccaaguccaucagccuggacgacuccuucgccaacaagacccugugcgacagcaaguucaacggccucaagggggagcggacccccuacgaguucuaccagaucaacaacgacgcgaaccuguggggcggguccaagagcugggaggagaucgagcgccgcaccuuccggauccugcccuacagcaaggccaagcgcuucacguccaagaccaaguucgagaccaacgacuucauccagcggcagcucaacgacacccgcuacaucagcaagaagacgaaggagauccugucccagaucugcgaggacgugcgggucaugccgggcagccugaccgccgagcuccgcaagcuguggggccugaacaacauccuccaccccgccuucgugcuggaccugcccgcccuccacaucgacgcgaacaagcacaucccccacuacgugguccuggacgaggacaacgugccgauccugucccagcggaucuacaacgacaagcccauccucaaggccaaccagaccagcaucaccggguucguggacaacgagaucuucaaguccaaggagaaguacgucaaguucgaggugaaggcccccaaccugagcaacggcgaguacugggccaagcugcuccuguccaaccccaagagcaucgugcgcgucuucaaggagaagccgaaguccacggagaacgagaucguggugcgggggaagaucgagaaggagaaguucaagcacgagggccugagcgggaucaacgccgagggcaaggagaacggcaccuacugggcgaagcucuccaucgucgacaagaaguucaagaagcccaagaaggacgaccagcccaagaagaacgggaagcagauccugcuguucggcgccgugaaggaggggguguucagcuccuacauguacgagugcgacgccgaccucgaggacggcaaguacuggcugauccuggacaucgacuucgagaacgucgaguucgagaaggcccucaacgagcgcccggaggugcuggagaaccagauccugauccaggggaucaccaacgacgagaacguguucgucagcgacauggacugccagcaccaguuccucaugaacgagggcaagggcaaguacuacgugcuguucgacaucaucuccgaggugaacgaguucuaccccaucaagaccaagagccccgagcuggagaacgggcagagccucacggagggcaccaucugggucgacaaguacaccggggagaucaaguucgaccccaagaagaaccgggaggaccaccgccaccacgcgaucgacgcccuggugaucgcccugaccaaggagacguacuuccagcagcucucccggcgcaacgccagcuccgagaacaagaagcggggcaacgaguacgagaaggagcagcuggacuucgccgagccguggaaggaguuccacguggacgcgcagaaguccaucaacagcauccugaucagccacaagcagaacaagaacauccucaccaagaucaccaagaagaucaccaagaacgggaagaccuacaaguccgagggcaugagcguccgcggccagcugcacgacaagacguacuacgggcacaacaagaacugcaaggccgacgaguacguguaccggguggacaucaacaaccuguccuucagccagcucaccaacaucaucgaccugaaccugaaggccgucaucguggagggcgugaucaagaaguucgaggaguccgagaagcuccuguucaagaagaugaacagcaagguccagaaccuggacaaguccaaggugaagaagaucaaggccaagguggacaagauccucaaggagaccagcuucuucaugcccaacgaggggaagcgcuacauccggcugaacaucaucgagcccgccaacuucgagcgcaugcccgucccgaucaagaaggugcggauccgcaaggugcugcgcaacgcggagaagcucaacaacgagaucaagcaguucgucgacccccagaacaaccaccacgugcugaucuacaaggacgagaacggcaaccugaaggaggagguggucaccuucuggacgguggucgagcggaagcgcaccggcgagcccguguacaagcuccccuccgacgggaagaagaucgugaccacccugcagaucaacgacauguuccugcucggccugaacgaggacgagaucaacugggagaacccgaacuacaaccaccugaaggagcaccucuaccggguccagaaguucacgagcggggacuucuacuuccgcaucgccaagaccuccagcauccagaacggcgaggagaagcagcagaucaacuccuucgggcugggcaagaacggcuggcugacccacaaccccaucaaggugaagaucagcgugagcgggaagauccucaaggucuga

SEQ ID NO: 2296 - RNA, 4713 nt, Artificial Sequence
  Cas9 variant
auggagaacagcaacaacuccagcaagaaguacuaccugggccucgacauggggaccgacuccugcggcuggugcgugaccgacgacaaguacaacaucauccgcagccacaagaagaucuacgggcccgacggcaagcuggucaagcgggaggggugccaccuguggggcucccgccucuuccggccggccaacacggccaagagccgccggcugaaccgcaccgcgcggcgccggcuggcccgccggcgccggcgcaucauccuccugcgggagcuguuccagcccgagaucgacaagguggaccccaacuucuuccgccggcucgaccaguccaaccuguggaacgaggacaaggacaaggagcugcagauggagcacaacuuccucuucaacgacaaggaccugaccgacaaggaguacuacaaggacuuccccaccaucuaccaccuccgcaaggccauggugaacggccugacgaucaacggguacuacuacgacccgaagaagcaguucgacauccgggaggucuaccuggugcuggcccacaugaucaaguaccgcggcaacuuccucauggagggggacgugaaggacagcgucguggaccccaccuaccugaagcagugcuucgacaacaucgacgugauccugaucucccucaacaacggcgaggacgacgagaacgaggacgacaagaucgaccccagcgagugcugcuucaacgucgacgagaagaaggcccggaagcuggcgaacaacuuccaggagaccaacaagguguccgaccuggaggacgacgagcgcgaccucuucgggaaguucaacagcaaggacauccgcaagaagauccugaagcugaucaacggcggcuccggggugaagcucaaggacuuccugcccaaggagauccuggucgcccacgacggcgacgacgaguacggggacaagaagaucgaccucagcuccgagacccuggaggacgacaucaacggcuacagccugccggaguccuacguggagaucauccucgaggccaagaagaucuacgacuucaagacgcuggccuaccugcuccacggcaagagccugcugugcgacgcgauggugaacgucuacgaggagcacaaggagcagcucgccgcccugaagcggcuguacaagaaguacgccaccaaggagcaguacuacuucauguuccgcgacucccggauccucgacggggacgacagcgacgacgaggaggacaaggaggagagcaacaaggaggaguccaaggacaagaagaagaaggccagcuacguguccuacaucggcuacaccaagaccaacagcaaggcgaaguacacgggggcccacaucaccuccgagaagaacaucagcgcccugaucaagcagaucaaggacgaccugaaguucgacgaccucaaguccaagguggacgaccccagccagcagaacgagcuguccgacgaggacaagcuggacauccagugcaucgaggaggccaucgagagcaacaccuuccucccccgccagaacucccggaacaacggcgccuuccccuaccagcugaaccugaacgagaugcgcaccaucaucgagaaccagagcaaguacuacccguuccugaaggacaaggcgcccuccuuccccgacgggaagacggaggaguacaagaucgucagccuccugaaguucaagauccccuacuacaucggcccgcugucccagcccaacgacuacgugcgggacgacaagcgcgacaaccacugggugcaguuccggggcgagaacaaccaggggaucaucaaccccuggaacuucagccagaucgucgaccucgagggcaccgccgacaaguucaucuccaaccugaccaacuacugcaccuacaucuucggggagaacacgcugcccaaggagagccucaucuuccaggccuacaaggugcugaacgaccugaacaaccucaaggugaacggcucccugaucagcaaggaggacaaggacuacaucauccagaacgucuaccugaagaagaagaagaucaaggggaaggacaucgugaacgcccucaagaacaaguacaagcugagcgacgaggacccgaccgucaccaccaagggcuccggcaagagcaucggggaggacgagguggaccugacgauguucaacuccagccucuccagcuucaucgacauguccgaccccaacgccuucggccccgaguucuacaaggacagcaacaaguucgagcuggcggagaaggugaucgagcugaucaccaucgucgaggacaaggaccuccugaaggagcgccugaagaagcucgggcuguccgacaaccaggugaacuaccuguucaagcagaaguacagcggcugggcgccccucucccggaagcugcuggacgggaucaccaucgacugcgugaacgagaacaccggcgaggccuacccggucacgaucaucgacgugaugcgcgacacgccccucaacuucauggagaucuacgagaccaaggagagccaguucuccggcuucaaggagaagguggccgagcugaacgacgagaagaagcugagccgggacgaccucaucgaggaguccuacgccagccccgccaugaagcgcuccguccggcagaccuucaaggugaucgacgagcugaagaacacccugaacaucgaccacuucgaccgcaucuucguggaggccacccgggcccccggggaggccggcaagauggucaagagccgcaagaagcagcuccaggaggcguacgacgccgccaaggaccugguggaccaggagagccgggacgaccugcagaagcuccgcgacgaccuggagaagcagaccgacgaccagcugcgccggaagaagguguaccucuacuucaugcagcuggggcgcuccgucuacagcggcgagaagaucgaccugaacgagcucgacaagaacuacgacaucgaccacaucaucccgcaggccaagcugaaggacgacuccuucaacaacauggugcugguggagcgggagcucaacaacaagaagcaggacgaguaccccauccccagcaccaucaucuccgagcacggccgcaacuggauccagaagcuggccaagauccaggacaagaacaagcggagcuacuucaugccgaaggacaaggcgaaccgccugcuccggcccgaguccaagcagcugacgagcgacgagcugaacggguucaucaaccgccagcucacccugaccaaccaguccgucaaggccgugugcgacauccugaagaugaccgagaagggcagcgagaucguguacuccaaggccaacuucgucagcgacuuccggaagcucugcggggagcugcgccccuccuacgacgccuucgugaaggugcgggacaucaacgacuuccaccacgccaacgacgcguaccugaacaucgucgugggcaacguguacuacgagaaguucaagaacuucuacaucaacaaccgcaucgacuacgacaacaacgggaagaaggaccucagcguccuggccuccaagcuguucaccaagacgcaggccgacgacaagaccggcaacaucuacugggaggcccgguuccacaacgagaaggagaccgacagcaacggcaaggagcgcaccaucaaggugcgggacgaggggacggaguccaccuucgacaagaucgaguacuacauggagcucaacgacccccuggugacccagaugcaguacacccugagcggcaagcagggguucuucaagaagaucacgcucaagaccaaggccaaggacaacgaggacaacuccgacaagcuguucccgcugaagcaguaccuccgcagcgacagcaacaaggucauggacgugaacaaguacggcggguacuccgacaugaucacccccuacuucaugcuggugcagagcgagggcaagaagggcaagcacaucuacucccuggagagcauccccaccaucuaccucaaguccuucaagaagaaggaggaggacaucaucaacuaccugagcugcaagaacaagcugaagaaccccgucgugaucuccgacaagcuccugaugcggacgaucgugaagaucccguacuucaagaacgacagcaaccugucccucgucaagcuggggaccagcggccgcaccgggaacaacaucaucuacaucaaccuguccgagcucauccugcccaucgaguggaagaacuacuaccggaagaucagcaaccugcucggcaccaacguguccagcacgaagcccaaggaccuguccaaguucaccgagcagaugaagaacgaccccaccagcacccugguggacggguccaacaaggucgagcacgacaagaacaaccgcuucuucagcuaccucaucaacaacgugaucaacaagccgaucuucgagggccugcccaagacguccugcagcuucaucaagcuggagagcaaguacgacgaguucugcucccucaacacccuggagcaggcgaagaucaucgccaccaucaucaagcugcucagcugcaaguccgugcagggcugcaagcugagcaaccuguccgggcuccccagcucccugggcgcccugaucagcaacaaggcccugaccgaggggacgaucaucuccaaggagagcuccugcggccucaaggagaacaucaucuucgucgugcccaacgacuga

SEQ ID NO: 2297 - RNA, 5067 nt, Artificial Sequence
  Cas9 variant
auggaguucaagaaggugcugggccucgacaucgggaccaacagcaucggcugcgcccugcugucccuccccaagagcauccaggacuacgggaagggcgggcgccuggaguggcugaccucccgggucaucccgcucgacgccgacuacaugaaggcguucaucgacggcaagaacggccugccccaggugaucacgcccgccgggaagcgccggcagaagcgcggcagccggcgccugaagcaccgguacaagcuccgccggucccgccugauccggguguucaagacccugaacuggcuccccgaggacuucccgcuggacaaccccaagcgcaucaaggagaccaucagcaccgaggggaaguucuccuuccggaucagcgacuacguccccaucuccgacgagagcuaccgcgaguucuaccgggaguucggcuaccccgagaacgagaucgagcaggugaucgaggagaucaacuuccgccggaagacgaaggggaagaacaagaacccgaugaucaagcugcuccccgaggacuggguggucuacuaccugcgcaagaaggcccugaucaagcccaccaccaaggaggagcucauccggaucaucuaccuguucaaccagcgccggggcuucaaguccagccgcaaggaccugaccgagacggccauccucgacuacgacgaguucgccaagcgccuggcggagaaggagaaguacuccgccgagaacuacgagaccaaguucgugagcaucaccaaggugaaggaggucguggagcugaagaccgacggccggaaggggaagaagcgcuucaaggugauccucgaggacucccggaucgagcccuacgagaucgagcgcaaggagaagccggacugggagggcaaggaguacacguuccuggucacccagaagcuggagaaggggaaguucaagcagaacaagcccgaccuccccaaggaggaggacugggcccugugcaccaccgcccuggacaaccggaugggcagcaagcaccccggcgaguucuucuucgacgagcuccugaaggcguucaaggagaagcgcggguacaagauccggcaguacccggugaaccgcuggcgguacaagaaggagcuggaguucaucuggacgaagcagugccagcucaaccccgagcugaacaaccugaacaucaacaaggagauccuccgcaagcuggccaccgugcuguaccccucccagagcaaguucuucggccccaagaucaaggaguucgagaacuccgacguccuccacaucaucagcgaggacaucaucuacuaccagcgggaccugaagagccagaagucccugaucagcgagugccgcuacgagaagcggaaggggaucgacggcgagaucuacgggcucaagugcaucccgaaguccagcccccuguaccaggaguuccgcaucuggcaggacauccacaacaucaaggugauccggaaggaguccgaggugaacggcaagaagaagaucaacaucgacgagacccagcuguacaucaacgagaacaucaaggagaagcucuucgagcuguucaacagcaaggacucccugagcgagaaggacauccucgagcugaucucccugaacaucaucaacagcggcaucaagaucuccaagaaggaggaggagaccacgcaccgcaucaaccuguucgccaaccggaaggagcucaaggggaacgagaccaagagccgcuaccggaaggucuucaagaagcugggcuucgacggggaguacauccugaaccaccccuccaagcucaaccgccuguggcacagcgacuacuccaacgacuacgccgacaaggagaagaccgagaagagcauccuguccagccucggcuggaagaaccgcaacgggaagugggagaaguccaagaacuacgacguguucaaccugccccuggagguggccaaggcgaucgccaaccucccgccccugaagaaggaguacggcagcuacagcgcccuggccauccggaagaugcucgucgugaugcgcgacggcaaguacuggcagcaccccgaccagaucgccaaggaccaggagaacaccucccugaugcuguucgacaagaaccucauccagcugacgaacaaccagcggaaggugcugaacaaguaccuccugacccuggcggagguccagaagcgcagcacccucaucaagcagaagcugaacgagaucgagcacaaccccuacaagcuggagcucguguccgaccaggaccuggagaagcagguccugaagagcuuccucgagaagaagaacgaguccgacuaccugaaggggcugaagaccuaccaggccggcuaccucaucuacgggaagcacagcgagaaggacgugccgaucgugaacucccccgacgagcugggcgaguacauccggaagaagcugcccaacaacagccuccgcaacccgaucgucgagcaggugauccgggagacgaucuucaucgugcgcgacgucuggaaguccuucgggaucaucgacgagauccacaucgagcugggccgggagcugaagaacaacagcgaggagcgcaagaagaccuccgagagccaggagaagaacuuccaggagaaggagcgggcccgcaagcuccugaaggagcugcucaacuccagcaacuucgagcacuacgacgagaacggcaacaagaucuucuccagcuucaccgugaaccccaaccccgacuccccccuggacaucgagaaguuccggaucuggaagaaccagagcgggcugaccgacgaggagcucaacaagaagcugaaggacgagaagaucccgacggagaucgaggugaagaaguacauccuguggcucacccagaagugccgcagccccuacaccggcaagaucaucccccuguccaagcuguucgacagcaacgucuacgagaucgagcacaucaucccccgguccaagaugaagaacgacagcaccaacaaccucgugaucugcgagcugggggugaacaaggccaagggcgaccgccuggccgcgaacuucaucuccgagagcaacggcaagugcaaguucggggaggucgaguacacgcuccugaaguacggcgacuaccugcaguacugcaaggacaccuucaaguaccagaaggccaaguacaagaaccuccuggccaccgagccgcccgaggacuucaucgagcggcagaucaacgacacccgcuacaucgggcggaagcuggccgagcuccugacccccguggugaaggacuccaagaacaucaucuucacgaucggcagcaucaccuccgagcugaagaucaccugggggcucaacggcgucuggaaggacauccugcgcccccgguucaagcgccuggagagcaucaucaacaagaagcucaucuuccaggacgaggacgacccgaacaaguaccacuucgaccuguccaucaacccccagcuggacaaggagggccucaagcgccuggaccaccggcaccacgcccuggacgcgaccaucaucgccgccacgacccgcgagcacgugcgguaccucaacagccugaacgccgcggacaacgacgaggagaagcgcgaguacuuccugucccucugcaaccacaagauccgggacuucaagcugcccugggagaacuucaccagcgaggugaaguccaagcugcucagcugcgucguguccuacaaggagagcaagcccauccuguccgacccguucaacaaguaccugaagugggaguacaagaacgggaaguggcagaagguguucgccauccagaucaagaacgaccgcuggaaggccguccggcgcagcauguucaaggagcccaucggcaccguguggaucaagaagaucaaggaggugagccucaaggaggccaucaagauccaggccaucugggaggaggucaagaacgaccccgugcggaagaagaaggagaaguacaucuacgacgacuacgcgcagaaggugaucgccaagaucguccaggagcuggggcuguccagcuccaugcgcaagcaggacgacgagaagcucaacaaguucaucaacgaggccaaggugagcgccggcgugaacaagaaccugaacacgaccaacaagaccaucuacaaccuggaggggcgguucuacgagaagaucaaggucgccgaguacgugcucuacaaggcgaagcgcaugccccugaacaagaaggaguacaucgagaagcugucccuccagaagauguucaacgaccugccgaacuucauccuggagaagagcauccucgacaacuaccccgagauccugaaggagcuggaguccgacaacaaguacaucaucgagccccacaagaagaacaaccccgugaaccggcuccugcuggagcacauccuggaguaccacaacaacccgaaggaggccuucagcaccgagggccucgagaagcugaacaagaaggccaucaacaagaucggcaagcccaucaaguacaucacgcgccuggacggggacaucaacgaggaggagaucuuccggggcgccgucuucgagaccgacaagggguccaacguguacuucgugauguacgagaacaaccagaccaaggaccgcgaguuccucaagcccaacccgagcaucuccguccugaaggccaucgagcacaagaacaagaucgacuucuucgcgcccaaccggcugggcuucagccgcaucauccucucccccggggaccugguguacgugcccaccaacgaccaguacguccugaucaaggacaacagcuccaacgagacgaucaucaacugggacgacaacgaguucaucagcaaccggaucuaccaggugaagaaguucaccggcaacuccugcuacuuccucaagaacgacaucgccagccugauccuguccuacagcgccagcaacggcgugggggaguucggcucccagaacaucagcgaguacuccgucgacgacccgcccauccgcaucaaggacgugugcaucaagauccgcguggaccggcucgggaacguccgcccccuguga

SEQ ID NO: 2298 - RNA, 3924 nt, Artificial Sequence
  Cpf1 variant
augacccaguucgagggcuucaccaaccuguaccaggugagcaagacgcuccgcuucgagcugaucccccaggggaagacccugaagcacauccaggagcagggcuucaucgaggaggacaaggcccggaacgaccacuacaaggagcucaagccgaucaucgaccgcaucuacaagaccuacgccgaccagugccugcagcugguccagcucgacugggagaaccuguccgcggccaucgacagcuaccggaaggagaagaccgaggagacgcgcaacgcccugaucgaggagcaggccaccuaccggaacgccauccacgacuacuucaucgggcgcaccgacaaccucaccgacgcgaucaacaagcggcacgccgagaucuacaagggccuguucaaggccgagcuguucaacgggaaggugcucaagcagcugggcacggugaccaccaccgagcacgagaacgcccugcuccgcuccuucgacaaguucacgaccuacuucagcggcuucuacgagaaccggaagaacgucuucuccgcggaggacaucagcaccgccaucccccaccgcaucgugcaggacaacuuccccaaguucaaggagaacugccacaucuucacccggcugaucacggccgugcccucccugcgcgagcacuucgagaacgucaagaaggccaucgggaucuucgugagcaccuccaucgaggagguguucagcuucccguucuacaaccagcuccugacccagacccagaucgaccuguacaaccagcuccugggcgggaucucccgggaggccggcacggagaagaucaaggggcugaacgagguccucaaccuggcgauccagaagaacgacgagaccgcccacaucaucgccagccugccccaccgcuucaucccccucuucaagcagauccuguccgaccggaacacccugagcuucauccucgaggaguucaaguccgacgaggaggugauccagagcuucugcaaguacaagacccugcugcgcaacgagaacgugcucgagacggccgaggcccuguucaacgagcugaacuccaucgaccucacccacaucuucaucagccacaagaagcuggagaccaucuccagcgcgcugugcgaccacugggacacccuccggaacgcccuguacgagcgccggaucagcgagcugacgggcaagaucaccaaguccgccaaggagaagguccagcgcagccucaagcacgaggacaucaaccugcaggagaucaucuccgccgccggcaaggagcugagcgaggcguucaagcagaagaccuccgagauccucagccacgcccacgccgcccuggaccagccccugccgaccacgcucaagaagcaggaggagaaggagauccugaagucccagcuggacagccugcucgggcuguaccaccuccucgacugguucgccguggacgaguccaacgagguggaccccgaguucagcgcgcggcugaccggcaucaagcuggagauggagcccucccucagcuucuacaacaaggcccgcaacuacgccaccaagaagcccuacuccgucgagaaguucaagcugaacuuccagaugccgacccuggccagcgggugggacgugaacaaggagaagaacaacggcgcgauccucuucgugaagaacggccuguacuaccuggggaucaugcccaagcagaagggccgcuacaaggcccucuccuucgagcccacggagaagaccagcgagggguucgacaagauguacuacgacuacuuccccgacgccgccaagaugaucccgaagugcuccacccagcugaaggccgucaccgcgcacuuccagacccacacgacccccauccugcucagcaacaacuucaucgagccccuggagaucaccaaggagaucuacgaccugaacaaccccgagaaggagccgaagaaguuccagaccgccuacgccaagaagacgggcgaccagaagggguaccgggaggcccucugcaaguggaucgacuucacccgcgacuuccuguccaaguacaccaagaccacgagcaucgaccugagcucccuccggcccagcucccaguacaaggaccugggcgaguacuacgccgagcugaacccccuccuguaccacaucagcuuccagcgcaucgcggagaaggagaucauggacgccguggagaccggcaagcuguaccucuuccagaucuacaacaaggacuucgccaaggggcaccacggcaagcccaaccugcacacccuguacuggaccggccucuucuccccggagaaccuggccaagacgagcaucaagcugaacgggcaggccgagcuguucuaccggcccaagucccgcaugaagcggauggcgcaccgccugggggagaagaugcugaacaagaagcucaaggaccagaagacccccauccccgacacccuguaccaggagcuguacgacuacgugaaccaccggcucagccacgaccuguccgacgaggcccgcgcccugcucccgaacgucaucaccaaggaggugagccacgagaucaucaaggaccggcgcuucacguccgacaaguucuucuuccacgugcccaucacccugaacuaccaggccgcgaacagccccuccaaguucaaccagcgggucaacgccuaccugaaggagcacccggagacccccaucaucggcaucgaccgcggcgagcggaaccucaucuacaucaccgugaucgacagcacggggaagauccuggagcagcgcucccugaacaccauccagcaguucgacuaccagaagaagcucgacaaccgggagaaggagcgcgucgccgcccggcaggccuggagcguggugggcaccaucaaggaccugaagcagggguaccugucccaggucauccacgagaucguggaccucaugauccacuaccaggcgguggucgugcuggagaaccugaacuucggcuucaagagcaagcgcaccgggaucgccgagaaggccguguaccagcaguucgagaagaugcucaucgacaagcugaacugccugguccucaaggacuaccccgccgagaaggugggcggcgugcugaaccccuaccagcugacggaccaguucaccagcuucgccaagauggggacccaguccggcuuccucuucuacgucccggcgcccuacaccagcaagaucgacccccugacgggguucguggaccccuucguguggaagaccaucaagaaccacgagucccgcaagcacuuccuggagggcuucgacuuccuccacuacgacgucaagaccggcgacuucauccugcacuucaagaugaaccggaaccugagcuuccagcgcgggcucccgggcuucaugcccgccugggacaucguguucgagaagaacgagacccaguucgacgccaaggggacgcccuucaucgccggcaagcggaucgugcccgucaucgagaaccaccgcuucaccgggcgguaccgcgaccuguacccggccaacgagcugaucgcgcuccuggaggagaagggcaucguguuccgggacggcuccaacauccugcccaagcuccuggagaacgacgacagccacgccaucgacaccaugguggcccugauccgcuccguccuccagaugcggaacagcaacgccgcgaccggggaggacuacaucaacucccccgugcgcgaccugaacggcgugugcuucgacagccgguuccagaaccccgaguggccgauggacgccgacgccaacggggccuaccacaucgcccugaagggccagcuccugcugaaccaccucaaggaguccaaggaccugaagcugcagaacgggaucagcaaccaggacuggcucgcguacauccaggagcugcgcaacuga

SEQ ID NO: 2299 - RNA, 3903 nt, Artificial Sequence
  Cpf1 variant
augagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcaacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcgcccaagaaccuggacaacccgagcaagaaggagcaggagcucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagcaucaaguaccagaaccaggggaagaaggaccugcugcaggccuccgcggaggacgacgugaaggccaucaaggaccuccuggaccagaccaacaaccugcugcacaagcucaagaucuuccacaucagccaguccgaggacaaggccaacauccuggacaaggacgagcacuucuaccugguguucgaggagugcuacuucgagcucgccaacaucgucccccuguacaacaagauccggaacuacaucacccagaagcccuacagcgacgagaaguucaagcugaacuucgagaacagcacccucgccaacggcugggacaagaacaaggagccggacaacacggcgauccuguucaucaaggacgacaaguacuaccugggcgugaugaacaagaagaacaacaagaucuucgacgacaaggccaucaaggagaacaagggggagggcuacaagaagaucguguacaagcuccugcccggggccaacaagaugcugcccaaggucuucuucuccgccaagagcaucaaguucuacaaccccuccgaggacauccuccgcauccggaaccacagcacccacaccaagaacggcuccccgcagaagggcuacgagaaguucgaguucaacaucgaggacugccgcaaguucaucgacuucuacaagcagagcaucuccaagcaccccgaguggaaggacuucggguuccgguucagcgacacccagcgcuacaacuccaucgacgaguucuaccgggagguggagaaccagggcuacaagcugacguucgagaacaucagcgaguccuacaucgacagcguggucaaccaggggaagcuguaccucuuccagaucuacaacaaggacuucuccgcguacagcaagggccgccccaaccugcacacccuguacuggaaggcccucuucgacgagcggaaccugcaggacguggucuacaagcugaacggggaggccgagcuguucuaccgcaagcaguccauccccaagaagaucacccacccggccaaggaggccaucgcgaacaagaacaaggacaaccccaagaaggagagcguguucgaguacgaccucaucaaggacaagcgguucaccgaggacaaguucuucuuccacugccccaucacgaucaacuucaaguccagcggcgccaacaaguucaacgacgagaucaaccugcuccugaaggagaaggccaacgacgugcacauccugagcaucgaccgcggcgagcggcaccucgccuacuacacccuggucgacgggaagggcaacaucaucaagcaggacaccuucaacaucaucgggaacgaccgcaugaagaccaacuaccacgacaagcuggccgcgaucgagaaggaccgcgacuccgcccggaaggacuggaagaagaucaacaacaucaaggagaugaaggagggcuaccucagccagguggugcacgagaucgccaagcuggucaucgaguacaacgccaucgugguguucgaggaccugaacuucggguucaagcgcggccgguucaaggucgagaagcaggucuaccagaagcucgagaagaugcugaucgagaagcugaacuaccucguguucaaggacaacgaguucgacaagacgggcggggugcugcgcgccuaccagcugaccgcgcccuucgagaccuucaagaagaugggcaagcagaccgggaucaucuacuacgugccggccggcuucaccuccaagaucugccccgugacgggguucgucaaccagcucuaccccaaguacgagagcguguccaagagccaggaguucuucuccaaguucgacaagaucugcuacaaccuggacaagggcuacuucgaguucagcuucgacuacaagaacuucggcgacaaggccgccaaggggaaguggaccaucgcguccuucggcagccggcugaucaacuuccgcaacuccgacaagaaccacaacugggacacccgggagguguaccccaccaaggagcucgagaagcugcugaaggacuacagcaucgaguacgggcacggcgagugcaucaaggccgccaucugcggcgaguccgacaagaaguucuucgccaagcucacgagcguccugaacaccauccugcagaugcgcaacuccaagaccgggaccgagcucgacuaccugaucagcccgguggccgacgugaacggcaacuucuucgacucccggcaggcgcccaagaacaugccccaggacgccgacgccaacggggccuaccacaucggccugaaggggcucaugcugcugggccgcaucaagaacaaccaggagggcaagaagcucaaccuggucaucaagaacgaggaguacuucgaguucgugcagaaccggaacaacuga

SEQ ID NO: 2300 - RNA, 1341 nt, Artificial Sequence
  Cpf1 variant
augaagcccgacaucaaggaccgcgaguacauguaccggcugaucaucggccagcuguucuacgacgggcaccagcagaucgccgugaaccucgccaacacccugggcugcagcgcgccgcccccgccgcccuccgacaagcuguuccgccucgucaccaucgccaagcaguucguggaggaccccgacuacaaggccgaggagaacacgaugcccaugcaguucgagaccagcuccgccgggcuggaccuccaguacgacgccgacguggcggccaccagccccgagcccucccaguacgagaccaucuaccugacgguccacaaggcccccugccgggccgcggccuucaacagcgacggcucccugaucgccaccgggagcgccgacugcuccaucaagaucauggacguggagcgcauccucgcccgggagaaggagcaccgcgagaugaacgagaacggccccgacgcgcaccaccccgugauccggacccuguacgaccacgucgacgugcgccgggacuucggccgcuucagcgacaagauccuggacuuccaggacgugaacaccgucaucuuccacccgcgggacgccauccucaucuccgggagcaacgacaagacggugaagcuguucgacuucuccaagaccgccgugaagcgcgccaugaagacccugagcgaggucuaccccgugcgggcccucuccugccaccccggcggggaguuccugcugguggcgaccgaccaccccacgguccgccucuacaacaucgagaccgcccaggccuacgccagcgccaacccggacgaccagcaccgggaguccgugaccgacgugcacuacagcgagaacgcgcgccuguacgucaccgccuccaaggacggcgacgugaaggugugggacggggucagcagccggugcguggagacguucaagcgcgcccacgacggcuccagcaucugcuccgccaaguucaccaagaacggcaaguacauccugaccagcgggauggacuccaucgugaagcucugggagcugagcaccaaccggugccugaucgucuacacgggcgccggggcgaccggcgcccaggacuaccccaccuccgccagcuucaaccagaacgaggacuucguccucuuccccgacgagaaguccggcagcaugugcuccugggaggcccgcaacgcggaccggaagcgccugcuggcccucgggcacaccagcgccugccgcacguucgugcacucccccagcaugccggccuucaugaccggcuccgacgaccaccgggcccgcuucugguaccggaagcccaccaccaacgacaacuga

SEQ ID NO: 2301 - RNA, 1293 nt, Artificial Sequence
  Cpf1 variant
augaagcccgacaucaaggaccgcgaguacauguaccggcugaucaucggccagcuguucuacgacgggcaccagcagaucgccgugacccucgccaacacccugggcugcagcgcgccggccccgccgcccuccgacaagcucuaccgccuggucacgaucgccaagcaguucguggaggaccccgacuacaaggccgaggagaagucccugcccaugcaguucgagaccgugagcaccgggcucgaccuggaguacgacgccgacguccagcccgugagccccgagcccucccaguacgagaccaucuaccugacggugcacaaggcgcccugccgggccgccgccuucaacagcgacggcucccucgucgcgaccgggagcgccgacugcuccaucaagaucauggacguggagcgcauccuggcccgggagaaggagcaccgcgagaugaacgagaacggccccgacgcccaccaccccgugauccggacccuguacgaccacgucgacgacgugaacaccguccucuuccacccgcgcgacgccauccugaucagcggcuccaacgacaagacggugaagcuguucgacuucagcaagaccgcggugaagcgggccaugaagacccucuccgagguguaccccguccgcgcccugagcugccaccccgggggcgaguuccugcucguggccaccgaccaccccacggugcggcuguacaacaucgagaccgcccaggcguacgccuccgccaacccggacgaccagcaccgcgagagcgucaccgacgugcacuacuccgagaacgcccggcuguacgugaccgccagcaaggacggggacgucaagaucugggacggcguguccaaccgcugcguggagacguucaagcgggcgcacgacgggagcgccaucugcagcgccaaguucaccaagaacggcaaguaccuccugaccuccggcauggacagcaucgucaagcugugggagcucuccaccaaccgcugccugaucguguacacgggggccggcgccaccggggcgcaggacuacgccaccagcgccuccuucaaccacaacgaggacuacguccuguuccccgacgagaaguccggcagcaugugcagcugggacgcccggaacuccgaccgcaagcggcuccuggcgcugggccacaccagcgccugccgcacguucgugcacucccccagcaugcccgccuucaugaccggguccgacgaccaccgggcccgcuucugguaccgcaagccggccaccaccgacaacuga

SEQ ID NO: 2302 - RNA, 3690 nt, Artificial Sequence
  Cpf1 variant
auggccgccagcaagcuggagaaguucaccaacugcuacucccucagcaagacccugcgcuucaaggcgauccccgugggcaagacgcaggagaacaucgacaacaagcggcugcucgucgaggacgagaagcgcgccgaggacuacaagggggugaagaagcugcuggaccgguacuaccucuccuucaucaacgacgugcugcacagcaucaagcugaagaaccucaacaacuacaucucccuguuccgcaagaagacccggaccgagaaggagaacaaggagcuggagaaccucgagaucaaccugcgcaaggagaucgccaaggccuucaagggcgccgcgggguacaagagccuguucaagaaggacaucaucgagaccauccucccggaggccgccgacgacaaggacgagaucgcccuggucaacuccuucaacggcuucacgaccgcguucaccggguucuucgacaaccgggagaacauguucagcgaggaggccaaguccaccagcaucgccuuccgcugcaucaacgagaaccugacgcgguacaucuccaacauggacaucuucgagaagguggacgccaucuucgacaagcacgaggugcaggagaucaaggagaagauccucaacagcgacuacgacgucgaggacuucuucgagggcgaguucuucaacuucgugcugacccaggagggcaucgacguguacaacgccaucaucgggggcuucgucaccgaguccggggagaagaucaagggccugaacgaguacaucaaccucuacaacgcgaagaccaagcaggcccugcccaaguucaagccccuguacaagcagguccucagcgaccgcgagucccugagcuucuacggggagggcuacacguccgacgaggaggugcuggagguguuccggaacacccucaacaagaacagcgagaucuucuccagcaucaagaagcuggagaagcuguucaagaacuucgacgaguacagcuccgccggcaucuucgugaagaacgggcccgccaucagcaccaucuccaaggacaucuucggcgaguggaaccucauccgcgacaaguggaacgccgaguacgacgacauccaccugaagaagaaggcgguggucaccgagaaguacgaggacgaccggcgcaagagcuucaagaagaucggguccuucagccuggagcagcuccaggaguacgccgacgccgaccuguccgugguggagaagcugaaggagaucaucauccagaaggucgacgagaucuacaagguguacggcagcuccgagaagcuguucgacgccgacuucgugcucgagaagucccugaagaagaacgacgccgucguggcgaucaugaaggaccuccuggacagcgucaagagcuucgagaacuacaucaaggccuucuucggcgaggggaaggagacgaaccgggacgaguccuucuacggcgacuucgugcuggccuacgacauccuccugaagguggaccacaucuacgacgccauccgcaacuacgucacccagaagccguacagcaaggacaaguucaagcuguacuuccagaacccccaguucaugggcgggugggacaaggacaaggagaccgacuaccgggccaccauccuccgcuacggguccaaguacuaccuggcgaucauggacaagaaguacgccaagugccugcagaagaucgacaaggacgacgugaacggcaacuacgagaagaucaacuacaagcuccugcccggccccaacaagaugcugccgaagguguucuucagcaagaaguggauggccuacuacaaccccuccgaggacauccagaagaucuacaagaacgggacguucaagaagggcgacauguucaaccugaacgacugccacaagcucaucgacuucuucaaggacagcaucucccgguaccccaaguggagcaacgccuacgacuucaacuucagcgagaccgagaaguacaaggacaucgcgggguucuaccgcgaggucgaggagcagggcuacaagguguccuucgagagcgccuccaagaaggagguggacaagcuggucgaggaggggaagcuguacauguuccagaucuacaacaaggacuucagcgacaagucccacggcacccccaaccuccacaccauguacuucaagcugcuguucgacgagaacaaccacggccagauccggcucagcgggggcgccgagcuguucaugcgccgcgccucccugaagaaggaggagcucguggugcacccggccaacagccccaucgcgaacaagaaccccgacaaccccaagaagacgaccacccuguccuacgacgucuacaaggacaagcgguucagcgaggaccaguacgagcugcacaucccgaucgccaucaacaagugccccaagaacaucuucaagaucaacaccgaggugcgcgugcuccugaagcacgacgacaaccccuacgucaucgggaucgaccggggcgagcgcaaccugcucuacaucgugguggucgacgggaagggcaacaucguggagcaguacucccugaacgagaucaucaacaacuucaacggcauccggaucaagacggacuaccacagccugcucgacaagaaggagaaggagcgcuucgaggcccggcagaacuggaccuccaucgagaacaucaaggagcugaaggccggguacaucagccaggugguccacaagaucugcgagcugguggagaaguacgacgccgugaucgcgcucgaggaccugaacuccggcuucaagaacagccgcgucaagguggagaagcaggucuaccagaaguucgagaagaugcugaucgacaagcucaacuacaugguggacaagaaguccaaccccugcgccaccgggggcgcccugaagggcuaccagaucaccaacaaguucgagagcuucaagagcauguccacgcagaacggguucaucuucuacaucccggccuggcugaccagcaagaucgaccccuccaccggcuucgugaaccuccugaagaccaaguacacgagcaucgccgacuccaagaaguucaucagcuccuucgaccggaucauguacgugcccgaggaggaccuguucgaguucgcgcucgacuacaagaacuucagccgcaccgacgccgacuacaucaagaaguggaagcuguacuccuacgggaaccggauccgcaucuucgccgccgcgaagaagaacaacgucuucgccugggaggaggugugccugaccagcgccuacaaggagcuguucaacaaguacggcaucaacuaccagcagggggacauccgggcccuccugugcgagcaguccgacaaggccuucuacagcuccuucauggcgcucaugagccugaugcugcagaugcgcaacuccaucaccggccggaccgacguggacuuccucaucagccccgucaagaacuccgacggcaucuucuacgacagccgcaacuacgaggcccaggagaacgccauccugccgaagaacgccgacgccaacggggcguacaacaucgcccggaaggugcugugggccaucggccaguucaagaaggccgaggacgagaagcucgacaaggugaagaucgccaucuccaacaaggaguggcuggaguacgcgcagacgagcgucaaguga

SEQ ID NO: 2303 - RNA, 3903 nt, Artificial Sequence
  Cpf1 variant
augagcaucuaccaggaguucgugaacaaguacucccugagcaagacccuccgcuucgagcugaucccccagggcaagacccuggagaacaucaaggcccgggggcucauccuggacgacgagaagcgcgccaaggacuacaagaaggcgaagcagaucaucgacaaguaccaccaguucuucaucgaggagauccuguccagcgucugcaucuccgaggaccuccugcagaacuacagcgacguguacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgccaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggguuccacgagaaccggaagaacguguacuccagcgacgacaucccgacguccaucaucuaccgcaucgucgacgacaaccugcccaaguuccucgagaacaaggcgaaguacgagagccugaaggacaaggcccccgaggccaucaacuacgagcagaucaagaaggaccuggccgaggagcucaccuucgacaucgacuacaagaccuccgaggugaaccagcggguguucagccuggacgaggucuucgagaucgcgaacuucaacaacuaccugaaccagagcggcaucaccaaguucaacacgaucaucggcgggaaguucgugaacggcgagaacaccaagcgcaaggggaucaacgaguacaucaaccucuacucccagcagaucaacgacaagacccugaagaaguacaagaugagcgugcuguucaagcagauccucuccgacaccgagagcaaguccuucgucaucgacaagcuggaggacgacagcgacguggugacgaccaugcaguccuucuacgagcagaucgccgccuucaagaccgucgaggagaaguccaucaaggagacccugagccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcaggucgcgcccaagaaccuggacaacccgagcaagaaggagcaggaccucaucgccaagaagaccgagaaggccaaguaccugucccuggagacgaucaagcucgcccuggaggaguucaacaagcaccgggacaucgacaagcagugccgcuucgaggagauccuggccaacuucgcggccauccccaugaucuucgacgagaucgcccagaacaaggacaaccucgcccagaucagccugaaguaccagaaccaggggaagaaggaccugcuccaggccuccgcggaggaggacgugaaggccaucaaggaccugcuggaccagaccaacaaccugcuccaccggcugaagaucuuccacaucagccaguccgaggacaaggccaacauccuggacaaggacgagcacuucuaccucguguucgaggagugcuacuucgagcuggccaacaucgugccccuguacaacaagauccgcaacuacaucacccagaagcccuacagcgacgagaaguucaagcucaacuucgagaacagcacccuggccaacggcugggacaagaacaaggagccggacaacacggcgauccuguucaucaaggacgacaaguacuaccucggcgugaugaacaagaagaacaacaagaucuucgacgacaaggccaucaaggagaacaagggggagggcuacaagaagaucgucuacaagcugcugcccggggccaacaagaugcuccccaagguguucuucuccgccaagagcaucaaguucuacaaccccuccgaggacauccugcggauccgcaaccacagcacccacaccaagaacggcaacccgcagaagggcuacgagaaguucgaguucaacaucgaggacugccggaaguucaucgacuucuacaaggaguccaucagcaagcaccccgaguggaaggacuucggguuccgcuucuccgacacccagcgguacaacagcaucgacgaguucuaccgcgagguggagaaccagggcuacaagcugacguucgagaacaucuccgagagcuacaucgacuccgucgugaaccaggggaagcucuaccuguuccagaucuacaacaaggacuucagcgcguacuccaagggccggcccaaccugcacacccucuacuggaaggcccuguucgacgagcgcaaccugcaggacgucguguacaagcucaacggggaggccgagcuguucuaccggaagcagagcauccccaagaagaucacccacccggccaaggaggccaucgcgaacaagaacaaggacaaccccaagaaggaguccguguucgaguacgaccugaucaaggacaagcgcuucaccgaggacaaguucuucuuccacugccccaucacgaucaacuucaagagcuccggcgccaacaaguucaacgacgagaucaaccuccugcugaaggagaaggccaacgacguccacauccucagcaucgaccggggcgagcgccaccuggccuacuacacccugguggacgggaagggcaacaucaucaagcaggacaccuucaacaucaucgggaacgaccgcaugaagaccaacuaccacgacaagcucgccgcgaucgagaaggaccgggacagcgcccgcaaggacuggaagaagaucaacaacaucaaggagaugaaggagggcuaccugucccaggugguccacgagaucgccaagcuggugaucgagcacaacgccaucguggucuucgaggaccucaacuucggguucaagcggggccgcuucaagguggagaagcaggucuaccagaagcuggagaagaugcugaucgagaagcucaacuaccugguguucaaggacaacgaguucgacaagacgggcggggugcugcgggccuaccagcucaccgcgcccuucgagaccuucaagaagaugggcaagcagaccgggaucaucuacuacgugccggccggcuucaccagcaagaucugccccgucacgggguucgugaaccagcuguaccccaaguacgaguccgugagcaagucccaggaguucuucagcaaguucgacaagaucugcuacaaccuggacaagggcuacuucgaguucuccuucgacuacaagaacuucggcgacaaggccgccaaggggaaguggaccaucgcgagcuucggcucccgccucaucaacuuccggaacagcgacaagaaccacaacugggacacccgcgaggucuaccccaccaaggagcuggagaagcugcucaaggacuacuccaucgaguacgggcacggcgagugcaucaaggccgccaucugcggcgagagcgacaagaaguucuucgccaagcugacguccgugcugaacaccauccuccagaugcggaacagcaagaccgggaccgagcuggacuaccugaucuccccgguggccgacgucaacggcaacuucuucgacagccgccaggcgcccaagaacaugccccaggacgccgacgccaacggggccuaccacaucggccucaaggggcugaugcugcucgaccggaucaagaacaaccaggagggcaagaagcugaaccuggugaucaagaacgaggaguacuucgaguucgugcagaaccgcaacaacuga

SEQ ID NO: 2304 - RNA, 1071 nt, Artificial Sequence
  Cpf1 variant
augaagaccaacuaccacgacaagcuggccgccaucgagaaggaccgcgagagcgcgcggaaggacuggaagaagaucaacaacaucaaggagaugaaggagggcuaccucucccaggugguccacgagaucgccaagcuggugaucggguacaacgccaucguggucuucgaggaccugaacuucggcuucaagcgcgggcgguucaagguggagaagcaggucuaccagaagcucgagaagaugcugaucgagaagcugaacuaccucguguucaaggacaacgaguucgacaaggccggcggggugcugcgcgccuaccagcugaccgcgcccuucgagacguucaagaagaugggcaagcagaccggcaucaucuacuacgugccggccgacuucaccagcaagaucugccccgucaccggguucgugaaccagcucuaccccaaguacgaguccgugagcaagucccaggaguucuucagcaaguucgacaagaucugcuacaaccuggacaagggcuacuucgaguucuccuucgacuacaagaacuucggggacaaggccgccaagggcaaguggacgaucgcgagcuucgggucccggcugaucaacuuccgcaacagcgacaagaaccacaacugggacacccgggaggucuaccccaccaaggagcucgagaagcugcugaaggacuacuccaucgaguacggccacggcgagugcaucaaggccgccaucuacgccgagaacgacaagaaguucuucgccaagcucaccagcauccugaacuccauccugcagaugcgcaacagcaagacggggaccgagcucgacuaccugaucuccccgguggcggacgugaacggcaacuucuucgacagccggcacgcccccaagaacaugccccaggacgccgacgccaacggggccuaccacaucggccugaagggccucaugcugcuguaccgcaucaagaacaaccaggacgggaagaagcucaaccuggucaucaagaacgaggaguacuucgaguucgugcagaaccggaacaaguccagcaagaucuga

SEQ ID NO: 2305 - RNA, 3792 nt, Artificial Sequence
  Cpf1 variant
auggaggacuacagcggcuucgugaacaucuacuccauccagaagacccugcgcuucgagcucaagcccgucgggaagacccuggagcacaucgagaagaagggcuuccugaagaaggacaagauccgggccgaggacuacaaggccgugaagaagaucaucgacaaguaccaccgcgcguacaucgaggagguguucgacagcguccuccaccagaagaagaagaaggacaagacgcgguucuccacccaguucaucaaggagaucaaggaguucagcgagcuguacuacaagaccgagaagaacaucccggacaaggagcgccuggaggcccucuccgagaagcugcggaagaugcuggugggggccuucaagggcgaguucagcgaggagguggccgagaaguacaagaaccucuucuccaaggagcugauccgcaacgagaucgagaaguucugcgagaccgacgaggagcggaagcaggucagcaacuucaaguccuucacgaccuacuucaccggguuccacagcaaccgccagaacaucuacuccgacgagaagaaguccaccgccaucggcuaccggaucauccaccagaaccugcccaaguuccucgacaaccugaagaucaucgagagcauccagcgccgguucaaggacuuccccuggagcgaccugaagaagaaccucaagaagaucgacaagaacaucaagcugacggaguacuucuccaucgacggcuucgugaacgugcugaaccagaaggggaucgacgcguacaacaccauccucggcggcaagagcgaggaguccggggagaagauccaggggcugaacgaguacaucaaccuguaccgccagaagaacaacaucgaccggaagaaccuccccaacgucaagauccuguucaagcagauccugggcgaccgcgagaccaagagcuucaucccggaggccuuccccgacgaccaguccgugcucaacagcaucaccgaguucgccaaguaccugaagcuggacaagaagaagaaguccaucaucgccgagcucaagaaguuccugagcagcuucaaccgguacgagcuggacggcaucuaccucgcgaacgacaacucccuggccagcaucuccacguuccuguucgacgacuggagcuucaucaagaaguccgugagcuucaaguacgacgaguccgucggggaccccaagaagaagaucaagagcccccucaaguacgagaaggagaaggagaaguggcugaagcagaaguacuacaccaucuccuuccugaacgacgccaucgagagcuacuccaagagccaggacgagaagcgcgugaagauccggcucgaggccuacuucgccgaguucaaguccaaggacgacgcgaagaagcaguucgaccugcuggagcgcaucgaggaggccuacgccaucguggagccgcuccugggcgccgaguacccccgggaccgcaaccugaaggccgacaagaaggaggucgggaagaucaaggacuuccucgacagcaucaagucccugcaguucuuccugaagccccuccugagcgcggagaucuucgacgagaaggaccugggcuucuacaaccagcucgagggcuacuacgaggagaucgacuccaucgggcaccuguacaacaaggugcggaacuaccugaccggcaagaucuacagcaaggagaaguucaagcugaacuucgagaacagcacccuccugaaggggugggacgagaaccgcgagguggccaaccugugcgucaucuuccgcgaggaccagaaguacuaccucggcgugauggacaaggagaacaacacgauccuguccgacauccccaaggugaagccgaacgagcuguucuacgagaagauggucuacaagcucauccccacgccccacaugcagcugccccggaucaucuucagcuccgacaaccugagcaucuacaacccguccaagagcauccucaagauccgcgaggccaaguccuucaaggaggggaagaacuucaagcugaaggacugccacaaguucaucgacuucuacaaggagagcaucuccaagaacgaggacuggagccgguucgacuucaaguucuccaagaccagcuccuacgagaacaucagcgaguucuaccgcgagguggagcggcagggcuacaaccuggacuucaagaagguguccaaguucuacaucgacagccucgucgaggacggcaagcuguaccuguuccagaucuacaacaaggacuucuccaucuucagcaaggggaagcccaaccuccacaccaucuacuuccgcagccuguucuccaaggagaaccugaaggacgugugccucaagcugaacggcgaggccgagauguucuuccggaagaaguccaucaacuacgacgagaagaagaagcgcgaggggcaccaccccgagcuguucgagaagcucaaguaccccauccugaaggacaagcgguacagcgaggacaaguuccaguuccaccucccgaucagccucaacuucaaguccaaggagcgccugaacuucaaccugaaggucaacgaguuccucaagcggaacaaggacaucaacaucaucggcaucgaccgcggggagcggaaccugcuguaccucgugaugaucaaccagaagggcgagauccugaagcagacccugcucgacagcaugcaguccggcaaggggcgccccgagaucaacuacaaggagaagcugcaggagaaggagaucgagcgggacaaggcccgcaagagcuggggcaccguggagaacaucaaggagcugaaggagggguaccucuccaucgucauccaccagaucagcaagcugaugguggagaacaacgcgaucgugguccuggaggaccucaacaucggcuucaagcgggggcgccagaagguggagcgccagguguaccagaaguucgagaagaugcugaucgacaagcugaacuuccucgucuucaaggagaacaagcccaccgagcccggcggcgugcugaaggccuaccagcugaccgacgaguuccaguccuucgagaagcucagcaagcagacgggguuccuguucuacgugccguccuggaacaccagcaagaucgacccccggaccggcuucaucgacuuccugcaccccgccuacgagaacaucgagaaggccaagcaguggaucaacaaguucgacuccauccgcuucaacagcaagauggacugguucgaguucaccgccgacacgcggaaguucuccgagaaccucaugcuggggaagaaccgcgucugggugaucugcaccaccaacguggagcgguacuucaccagcaagacggcgaacuccagcauccaguacaacagcauccagaucaccgagaagcugaaggagcuguucgucgacauccccuucuccaacggccaggaccugaagccggagauccugcgcaagaacgacgccguguucuucaagagccuccuguucuacaucaagaccacccugucccuccggcagaacaacggcaagaagggggaggaggagaaggacuucauccugagccccguggucgacuccaagggccgcuucuucaacagccuggaggccuccgacgacgagcccaaggacgccgacgcgaacggggccuaccacaucgcccucaagggccugaugaaccugcucgugcugaacgagacgaaggaggagaaccugagccggccgaaguggaagaucaagaacaaggacuggcucgaguucgugugggagcgcaaccgguga

SEQ ID NO: 2306 - RNA, 2820 nt, Artificial Sequence
  Cpf1 variant
augaaccuguacagcaaccucaccaacaaguacucccugagcaagacccugcgcuucgagcucaucccccagggcgagacgcuggagaacaucaaggcccgggggcugauccucgacgacgagaagcgcgccaaggacuacaagaaggcgaagcagaucaucgacaaguaccaccaguucuucaucgaggagauccuguccagcgugugcaucuccgaggaccugcuccagaacuacagcgacgucuacuucaagcugaagaaguccgacgacgacaaccugcagaaggacuucaagagcgccaaggacaccaucaagaagcacaucucccgguacaucaacgacagcgagaaguucaagaaccucuucaaccagaaccugaucgacgccaagaagggccaggaguccgaccugauccucuggcugaagcagagcaaggacaacgggaucgagcuguucaaggccaacuccgacaucaccgacaucgacgaggcccucgagaucaucaagagcuucaagggcuggaccacguacuucaagggguuccacgagaaccgcaagaacguguacuccagcgacgacaucccgaccuccaucaucuaccggaucguggacgacaaccugcccaaguucaucgagaacaaggcgaaguacgagaaccugaaggacaaggcccccgaggccaucaacuacgagcagaucaagaaggaccucgccgaggagcugaccuucgacaucgacuacaagaccagcgaggucaaccagcgcguguucucccuggacgagguguucgagaucgcgaacuucaacaacuaccucaaccagagcggcaucacgaaguucaacaccaucaucggcgggaaguucgucaacggcgagaacaccaagcggaaggggaucaacgaguacaucaaccuguacagccagcagaucaacgacaagacccugaagaaguacaagauguccgugcuguucaagcagauccugagcgacacggaguccaagagcuucgugaucgacaagcuggaggacgacuccgacgucgugaccaccaugcagagcuucuacgagcagaucgccgccuucaagacccucgaggagaaguccaucaaggagacgcugagccuccucuucgacgaccugaaggcccagaagcuggaccucuccaagaucuacuucaagaacgacaagagccugaccgaccugucccagcaggucuucgacgacuacagcgugaucggcaccgccgugcucgaguacaucacccagcaggucgcgcccaagaaccuggacaacccguccaagaaggagcaggaccugaucgccaagaagacggagaaggccaaguaccucagccuggagaccaucaagcuggcccucgaggaguucaacaaguaccgcgacaucgacaagcagugccgguucgaggagaucuucgccuccuucgcggacauccccgugcuguucgacgagaucgcccagaacaagaacaaccuggcccagaucagcaucaaguaccagaaccaggggaagaaggaccuccugcagaccuccgccgagguggacgugaaggccaucaaggaccugcuggaccagaccaacaaccuccugcacaagcugaagaucuuccacaucacgcagagcgaggacaaggcgaacauccucgacaaggacgagcacuucuaccuggucuucgacgagugcuacuucgagcuggccaacaucguggcccucuacaacaagauccgcaacuacaucacccagaagcccuacuccgacgagaaguucaagcugaacuucgagaacagcacccuggccaacggcugggacaagaacaaggagcccgacaacaccgccauccucuucaucaaggacgacaaguacuaccugggcgugaugaacaagaagaacaacaagaucuucgacgacaaggcgaucaaggagaacaagggggagggcuacaagaaggucguguacaagcugcucccgggggccaacaagaugcugcccaagguguucuucagcgccaaguccaucaacuucuacaaccccagcgaggacauccugcggauccgcaaccacuccacgcacaccaagaacggcagcccccagaagggcuacgagaagcucgaguucaacaucgaggacugccggaaguucaucgacuucuacaagcacuccaucagccgccacccggaguggaaggacuucggguuccgguucuccgacaccaagaaguacaacagcaucgacgaguucuaccgcgaggucgagaaccagggcuacaagcugaccuucgagaacaucuccgagagcuacaucgacucccugguggacgaggggaagcucuaccuguuccagaucuacaacaaggacuucagcgucuacuccaagggcaagcccaaccugcacacgcucuacuggaaggcccuguucgacgagcggaaccugcaggacgugguguacaagcucaacggggaggcggagcuguucuaccgcaagcagagcauccccaagaagaucacccaccccgccaaggaggccaucgccaacaagaacaaggacaacccgaagaaggaguccaucuucgaguacgaccugaucaaggacaagcgguucaccgaggacaaguucuucuuccacugccccaucaccaucaacuucaagagcuccggcgccaacaaguucaacgacgagaucaaccuccugcugaaggagaaggcgaacgacguccacauccucagcaucgaccgcggcgagcggcaccuggccuacuacacgcugguggacgggaagggcaacaucaucugcaagaacuga

SEQ ID NO: 2307 - RNA, 3795 nt, Artificial Sequence
  Cpf1 variant
augcuguuccaggaguucacccaccucuacccccugagcaagaccgugcgcuucgagcugaagccgaucggcaagacgcucgagcacauccacgccaaggacuuccugucccaggacgagaccauggccgacauguaccagaaggucaaggcgauccuggacgacuaccaccgggacuucaucgccgacaugaugagcgggguggugcucaccaagcuggccgaguucuacgaggucuaccuggcccuccgcaagacccccaaggacgacucccugcagaagcagcugacggagauccagaccgcccuccggaaggagaucgugaagcccaucggcagcgggggcaaguacaaggcgggguacgaccgccuguucggcgccaagcuguucaaggacggcaaggagcucggggaccuggccaaguucgugaucacccaggagggcgaguccagccccaagcuggcccacaucgcgcacuucgagaaguucuccaccuacuucacgggguuccacgacaaccggaagaacauguacagcgacgaggacaagcacaccgccaucgccuaccgccucauccacgagaaccugccgcgguucaucgacaaccugcagauccucgccaccaucaagcagaagcacuccgcccuguacgaccagaucgucaacgagcugaacgcgaacggccucgacgugagccuggccucccaccuggacggguaccacaagcuccugacccaggagggcaucacggccuacaacacccugcucggcgggaucagcggcgaggccgggucccgcaagauccagggcaucaacgagcugaucaacauccaccacaaccagcacugccagaaguccgagcggaucgccaagcugcgcccccuccacaagcagauccugagcgacggcaugggggugagcuuccugcccuccaaguucgcggacgacagcgaggucugccaggccgugaacgaguucuaccggcacuacgcccacguguucgccaagguccagucccucuucgaccgcuucgacgacuaccggaaggacggcaucuacguggagcacaagaaccugaacgagcugagcaagcaggccuucggggacuucgcgcuccugggccgcgugcuggacggguacuacgucgacguggugaaccccgaguucaacgagcgguucgccaaggccaagaccgacaacgccaaggagaagcucaccaaggagaaggacaaguucaucaagggcguccacagccuggccucccuggagcaggcgaucgagcacuacaucgccggccacgacgacgagagcgugcaggccgggaagcucggccaguacuucaagcacgggcuggccggcguggacaacccgauccagaagauccacaacucccacagcacgaucaagggguuccuggagcgcgagcggcccgcgggcgagcgcgcccuccccaagaucaaguccgacaagagccccgagaugacccagcugcggcagcugaaggagcugcucgacaacgcccugaacgucgugcacuucgccaagcugcucaccaccaagacgacccuggacaaccaggacggcaacuucuacggggaguucggcgcccuguacgacgagcucgcgaagaucgccacccuguacaacaaggugcgcgacuaccugucccagaagccguucagcaccgagaaguacaagcucaacuucgggaaccccacgcugcugaacggcugggaccucaacaaggagaaggacaacuucggggucauccugcagaaggacggcugcuacuaccuggcccuccuggacaaggcccacaagaagguguucgacaacgcccccaacgcgggcaaguccgucuaccagaagaugguguacaagcugcuccccgggccgaacaagaugcugcccaagguguucuucgccaagagcaaccuggacuacuacaaccccuccgccgagcuccuggacaaguacgcccagggcacccacaagaaggggaacaacuucaaccugaaggacugccacgcccucaucgacuucuucaaggcgagcaucaacaagcaccccgaguggcagcacuucggcuucgaguucuccccgaccagcuccuaccaggaccugagcgacuucuaccgggaggucgagccccagggcuaccaggugaaguucguggacaucaacgccgaguacaucgacgagcuggucgagcaggggcagcucuaccuguuccagaucuacaacaaggacuucucccccaaggcccacggcaagcccaaccugcacacccucuacuucaaggcccuguucagcgagaacaaccuggcgaacccgaucuacaagcucaacggggaggccgagaucuucuaccgcaaggccucccuggacaugaacgagacgaccauccaccgcgccggcgaggugcuggagaacaagaaccccgacaaccccaagaagcggcaguucguguacgacaucaucaaggacaagcgcuacacccaggacaaguucaugcuccacguccccaucaccaugaacuucggggugcagggcaugacgaucaaggaguucaacaagaaggugaaccagagcauccagcaguacaacgacgucaacgugaucggcaucgaccgcggggagcggcaccuccuguaccugaccgugaucaacagcaagggcgagauccuggagcagcggucccugaacgacaucaucaccaccagcgccaacgggacgcagaugaccaccccguaccacaagauccucgacaagcgcgagaucgagcggcugaacgcgcgcgucggcuggggcgagaucgagaccaucaaggagcugaaguccggguaccucagccacguggugcaccagaucucccagcugaugcugaaguacaacgccaucgucgugcucgaggaccugaacuucggcuucaagcgggggcgcuucaagguggagaagcagaucuaccagaacuucgagaacgcccugaucaagaagcucaaccaccuggcccugaaggacaaggccgacgacgagaucggcagcuacaagaacgcgcuccagcugaccaacaacuucacggaccugaaguccaucgggaagcagaccggcuuccucuucuacguccccgccuggaacaccagcaagaucgaccccgccaccggguucguggaccugcugaagccgcgguacgagaacaucgcccagucccaggccuucuucggcaaguucgacaagaucuucuacaacgcggacaagggcuacuucgaguucuacguggacuacgccaaguucacggacaaggccaagaacagccgccagaccugggucaucugcucccacggggacaagcgguacguguacgacaagaccgccaaccagaacaagggcgcgaccaucgggaucaacgugaacgacgagcucaagagccuguucgcccgcuaccacaucaacgacaagcagcccaaccuggucauggacaucugccagaacaacgacaaggaguuccacaagucccucauguaccugcugaaggcccuccuggcccugcgguacagcaacgccuccagcgacgaggacuucauccucucccccguggcggacgacaagggcguguucuucaacagcgcccuggccgacgacacgcagccccagaacgccgacgccaacggggcguaccacaucgcccugaagggccucuggcugcugaacgagcucaagaacagcaacgaccuggacaagaucaagcuggccaucgacaaccagaccuggcucaacuucgcccagaaccgcuga

SEQ ID NO: 2308 - RNA, 3903 nt, Artificial Sequence; identical to SEQ ID NO: 2303
  Cpf1 variant

SEQ ID NO: 2309 - RNA, 3756 nt, Artificial Sequence
  Cpf1 variant
augaaccacaugaagcaguucaccaaccaguucagccuguccaagacccuccgcuucgagcugaucccccagggcaagacgaaggaguucaucgagaucaacgggcugaucgagaaggacaacgagcgggccgugagcuacaagaaggucaagaagaucaucgacgaguaccacaaguacuucaucgagauggugcucugcgacuucaagcugcacggccuggagaccuacgagaccaucuucaacaagaaggagaaggacgacaccgacaagaaggaguucgacaacauccgcaacucccuccggaagcagaucgccgacgcguucgccaagaacccgaacgacgagaucaaggagcgcuucaagaaccuguucgccaaggagcugaucaagcaggaccuccugaacuucguggacgacgagcagaaggagcuggucaacgaguucaaggacuucacgaccuacuucaccggguuccaccagaaccggcgcaacauguacguggccgacgagaaggccaccgcgaucgccuaccggcucgugaacgagaaccugcccaaguucaucgacaaccugaagaucuacgagaagaucaagaaggacgcccccgagcucaucagcgaccugaacaagacgcuggucgagauggaggagaucgugcagggcaagacccucgacgagaucuucucccugagcuucuucaaccagacccugacccagacggggaucgagcucuacaacaucgugaucggcggccgcaccgccgacgaggggaagaccaagaucaagggccugaacgaguacaucaacaccgacuacaaccagaagcagacggacaagaagaagaagcaggcgaaguucaagcagcuguacaagcagauccucuccgaccggcacagcgucuccuucguggccgagaccuucgagaccgacgcccagcugcuggagaacaucgagcaguucuacagcuccgugcucugcaacuacgaggacgacgggcacaccacgaacaucuucgaggccaucaagaaccugaucaucggccugaagaccuucgaccucagcaagaucuaccugcgcaacgacaccucccugaccgacaucagccagaagcuguucggggacugguccaucaucagcuccgcccugaacgacuacuacgagaagcagaaccccaucagcuccaaggagaagcaggagaaguacgacgagcggaaggcgaaguggcugaagcaggacuucaacaucgagacgauccagaccgcccucaacgagugcgacagcgagaucaucaaggagaagaacaacaagaacaucgucagcgaguacuucgccaagcugggccuggacaaggacaacaagaucgaccuccugcagaagauccaccacaacuacguggugaucaaggaccugcucaacgagccguaccccgagaacaucaagcugggcaaccagaaggagcaggucucccagaucaaggacuuccuggacagcauccucaaccugauccacuuccugaagccccucucccugaaggacaaggacaaggagaaggacgagcuguucuacagccuguucaccgcccucuucgagcaccugucccagaccaucagcaucuacaacaaggugcgcaacuaccugacgcagaaggccuacuccaccgagaagaucaagcucaacuucgagaacagcacccugcugaacgggugggacgugaacaaggagcccgucaacaccuccgugaucuuccggaagaacggccucuucuaccuggggaucaugagcaaguccaacaaccgcaucuucgagcggaacgugccggucugcaagaacgaggagacggcguucgagaagaugaacuacaagcugcuccccggcgccaacaagaugcugcccaagguguuccugagcgccaagggcaucgaguccuuccagcccagcgccgagauccaguccaaguaccagaaggagacccacaagaagggggacgccuucgugcgcaaggacauggagaaccucaucgacuucuucaagcagagcaucgcgaagcacaccgacuggaagcacuucaaccaccaguucuccaagaccgagacguacaacgaccugagcgaguucuacaaggaggucgagaagcagggcuacaagcugaccuucaccaagcucgacgagaccuacaucaaccagcugguggacgaggggaagcuguaccucuuccagaucuacaacaaggacuucuccccguucagcaagggcaagcccaacaugcacacccuguacuggaagaugcuguucgacgagcagaaccuccagaacgucguguacaagcugaacggggaggccgagguguucuuccggcagagcuccaucaagcagacggaccgcaucauccacaaggccaaccaggccaucgacaacaagaacccccugaacaacaagaagcagagcuccuucaacuacgaccucaucaaggacaagcgguucacccuggacaaguuccaguuccacguccccaucacccugaacuucaaggccgagggcaacgaguaccucaacaccaaggugaacgaguaccucaagagcaacuccgacgugaagaucaucggccuggaccgcggggagcggcaccucaucuaccugacgcugaucaaccagaagggcgagcuccugaagcagcagagccugaacgucaucgcgaccucccaggagcacgagaccgacuacaagaaccuccuggugaacaaggagaacgagcgcgccaacgcccgccaggacuggaagaccaucgagacgaucaaggagcugaaggagggguaccucagccaggugguccaccagaucgccaccaugaugguggacgagaacgcgaucguggucauggaggaccugaacgccggcuucaugcgggggcgccagaagguggagcgccagguguaccagaagcuggagaagaugcucaucgagaagcugaacuaccuggucuucaagaacaacgacgugaacgagaccgccggcgugcucaacgcccugcagcugaccaacaaguucgaguccuucgagaagaugggcaagcagagcggguuccucuucuacgucccggccuggaacacguccaagaucgaccccgcgaccggcuucguggacuuccugaagcccaaguacgagagcguggagaaggccaagcuguucuucgagaaguucgaguccaucaaguucaacgccgacaagaacuacuucgaguucgaguucgacuacaagaaguucaccgagaaggccgaggggagccagaccaaguggacggucugcacccacuccgacgugcgguaccgguacaacccccagaccaaggccagcgacgaggugaacgucaccaacgagcucaagcugaucuucgacaaguucaagaucgaguacaagaacggcaagaaccugaagacggagcuccugcugcaggacgacaagcagcuguucuccaagcuccugcacuaccucgcgcugacccugaugcuccgccagagcaagagcgggaccgacaucgacuucauccuguccccgguggccaagaacggcguguucuacgacagccggaacgccaugcccaaccugcccaaggacgccgacgccaacggcgcguuccacaucgcccucaaggggcuguggugcguccagcagaucaagaaggccgacgaccugaagaagaucaagcucgccaucuccaacaaggaguggcugagcuucgugcagaaccugaaguga

SEQ ID NO: 2310 - RNA, 4173 nt, Artificial Sequence
  Cpf1 variant
augaucgacaacaccaaggagaagaaggagggcagcguguucgacggguucacccgcaaguaccagcuguccaagacgcuccgguucgagcugcgccccauccugaacaccccgaagaugcucgacgacgagcaggucaucaagaacgacgagacccggcgcaagaaguacgaggccgugaagcccugguucgaccagcugcaccgggaguucaucgaggacgcccucaagagcuucaaguucaagaaccucgcgaucuaccaggacaccuuccagacguggcagaaggaccgcaaguccaagcagaagaaggacacccuggugaagaucgaggucggccugcgggaggagaucgugcgccgguucgaggagguggccaacaucuggguccgcagcgagcaguacaagcuccuggggaucaagaaggagggccuggggaugcuguucgaggccggcguguuccggcugcugaaggagcgcuucaagaacgagaaggacaccaccguggacggcaacaacaucuucgacgaguggacgcgguggaccggguacuucaagaaguucuucgagacccgcaagaacuucuacaaguccgacgacaccagcacggccaucgccuaccgggucaucaaccagaaccuccgccgguucugcgagaacauccagaucuucgagaagaucuccgagaagaucgaguucagcgagguggagaaguccuucgacaucagcugcgcgggcaucuucucccuggccuacuacaacgccugccugcuccagggcgggaucgacaccuacaacaagaucaucgggggcgagguggacgagaaggacaagaagauccccggcaucaacgagcugaucaacaaguaccgccaggacaacagcggggagaagauccccuuccugaagcagcucgacaagcagauccacuccgccaaggaggcguucaucgagagcaucgagaccaacaaggagcuggucggcaagcugaagaccuucuacgagaacgccgaggugaagauccaguccuuccggaaccucaucgccgacaucgugacggacuacagcggguacgacaucgacaagaucuaccugaccaaggaggccgucucccacaacgccagccgcugguucgcguccuucgagagcuucgagcgggaccuguucgccgugguggccgagaagcagaacaagcucgucuacgagcugcugcgcacccacaagaacgacagcaagaucuccgacaaggacggcaaguucagcuucccggacuucaucaagugcucccacaucaagcgcgcccucgagaagcaggagggccggaucuggaagggggaguacuacgaggacaucguggacuucgagaagaucaaggacguguucacccaguuccugugcgucuucaaguucgagcuggagcagcaguucuuccgcaagacgaccagcgcccagaccggcgagcagaccaagaucggguacgagaucuucgugacgaagaucaacgagcucaucacccgggagaaccccgugaucgaccuggaggagaagaucgcgaucaagaacuucgccgacgccacccugcucaucuaccagaucgccaaguacuucgccgucgagaagcgccggggcuggcuggacaacuacgaccuggacgaccgcuucuacaaguccagcgacaucggguaccucaacuucuaccgggacgcguucgagcagaucgugcgccccuacaaccuguuccggaacuaccugaccaagaagcccuacaacacgaacaaguggguccucuccuucgagaacccgacccuggccgacggcugggacaagaacaaggagaagaccaacgccgccgugauccugcgcaaggacggccgguacuaccucgggaucaucaaggaggacugcaagagccuguucgccgaccgcuacuccaaggagaugagcgagggcaucgaguccgggagcuuccagaagauggcguacaaguucuuccccgaggccuccaagaugauccccaagugcagcacccagacgaagaacgugaaggagcacuuccggaaguccagcuccgacuacaaccuguuccacgagaaggacuacaagaucagcgucgccaucaccaagaacaucuacgagcucaacaacguguucuaccgcaaggacaacaucgaggaguccuucgugcccaagaacgacuucgagaagaagcugggcgucaagaaguuccagcggcaguaccuggagaucagccgcgacaacaacggguacaagcaggcccuggcgcaguggaucgaguucugcauccgguuccucaaggccuacaagagcaccaccaucuucgacuacucccgccugcgggaggccaaggaguacgagagccuggacgccuucuaccaggacaucaacgcccucacguacaacaucuccuucgugccgaucagcgagcaguacaucaaggagaagaacgacaacggcgagcuguuccuguucgagaucuacaacaaggacuggucccucggccccauggacaagaaccgcaagcgcaccaagaaccugcacacccuguacuucgagcagcuguucagcaaggagaacgagcaggagaacuuccucuuccagcugaacggggaggcggagcuguucuuccggcccaagaccgaggagaagcgccucggcuacaaggugugggacgccggggagaagaagugggucaaggccaaggagaaggaggacggcgccgugaucgaccggaagcgcuacgccaaggacaucauccuguuccacugccccaucacccucaaccggguguccgagagcaagacgaagcgcgagauggacgucgagauccgggaggugcuguccagcaccccgggggugcacaucaucggcgucgaccgcggcgagaagcaccuggcguacuacuccgugaucgaccagaacgggaagaucaucgagaccgacacccucaacagcaucggcaaggacgggcggggcaagcccguggaguacgccuccaagcuggagaagcgcgcccaggagcgggaggccagccgccgggacugggaggaggucgaggccaucaaggaccugaagaagggcuacaucucccaggugauccgcaaccucgcggaccugaucaucaagcacaacgccaucaucguguucgaggaccugaacaugcgguucaagcagauccgcgggggcaucgagaaguccgccuaccagcagcucgagcgggcccugaucgacaagcugagcuuccucgucaagaagggggaggaggaccccaagcagacgggccacauccugcgcgcguaccagcuggccgcccccgugaucgccuucaaggacauggggaagcagaccggccucaucuucuacacccaggccggcuacaccagcaagacgugcccggagugcggguaccggcgcaacaucaagugccuguucgagaacaucgagcaggcgaagacccugaucgagaaccucgagagcaucaacuacaacaagaaggaggacguguuccagaucuccuacagccuggagaagcuguccagcaaggaccagaagaaggagaagaaggucuccaacgagcucuacgccaagacccugaagaaggacaucuucauccugaccacgaagaacgcccuccgguacaagugguacgaccgcuacagcgagaaggccaagguggccaagcgcggcaucgacgaguacaagggggaggugaacgaguccgagaccaagaagggcgucgugaaggaguucaaccugaccgaguaccugaaggggcuccugaagaccuacgagaucgacuacgagcacggcggcauccgggagcagauccugagcguggcgcgcgggcgggaguucuacaaggacuuccucuacgcccuguuccugcucacggagacccgccacuccaucagcggccggaacaccgacuacauccagugccccgagugcgaguucgacucccgcaagggguucaaggacaucaaggaguucaacggcgacgccaacggggccuacaacaucgcccggaagggcaucaugauccuggagaagaucaagcaguucaagaaggacaacgacggcaaccuggagaagaugggguggggcgaccucagcaucuccaucgaggagugggacaaguucacccagaaggaguga

SEQ ID NO: 2311 - RNA, 4026 nt, Artificial Sequence
  Cpf1 variant
augaacgccgagaagaagugcgccuucaacgaguucaccaaccuguacgagcucagcaagacccugaaguucgagcugaagcccgugggcaagacgaaggagaucaucaagaacuuccgcgaggagcucgagaagaacaacccgauccagcuggacaaggagaucuccaucgcgaagcaggagaucaagaaggaccuggacauccuccaccgggaguucguccgccagagcuucgagcuggccuucaaggagaacaagaucaacuacgagaucuucuucgagaucuaccggaacuucaagaaguucuccaagaacaagaaguccgacgaguacaucgccgccaucaagaaccugaaggaggagaagaucaagcucgugaagaagaucgccgacuacuucgugaagauggaccaggaguggcgcaaguacuaccccagcgagaagaaguccuuccugcugaugagcaacggggucaucaaccuccugaucgacaucaacaaggaccggauggacuacagcuucauccccaaggaggugugcgagaagaucaagggcaaggggaagaucgagcuguacgagaaguucaacaagcacuucggcuaccucuccaaguacaacaccgcgcgcgagaacuucuacagcgacgacgugaagaacuccgccagcgucgccuaccgggccaucugcgagaaccuggagaaguucugcgacaacaagaucaagguggaggcggacaacuuccccaaggagaucaaggagaaguuccuggaguacuucaacaagaucaccgaccucuccuucuacaaccgcugccugagccagaacgggaucgaggaguaccacaaguucaaggacgagaucaaccgguccaucaacgagcuguacccgaacaacagcaagaacaagccccagaacauccccuaccucuccaagcuggacaagcagauccugagcgagaaggacaagcaguccuggaucgaggagggcuucaucgacgagaacaacuucaucuucgaguucgagaaguucaucaagaugaacgacaaguacauccccagcgagaagaagcuguucaacgaguucuucaucuuccagaacaacgacgaggugcuccagaagcuguuccuccugaagaagaccaucaacaacuucgccaacaucuaccuggacgacccgaagaaccucauggaccugaugcccagcaagggcacgaagaagcgcgacuaccugucccuccuggagaucaaggaggcccugaacagcuacgccgagaaccagaacaucggggagacccagaucuucaagaucaaguacgacgacgucaucgacaagaccaagacccccuucgagugcuucaugaagaucuggaaguacgaguacgaccuccuguacaacgagggcgacgggaagaagaacaucgaggagggcugggagaagaucugcgagaagcugcagaacaagaaggacgaguucacgggggacuacggcaaguacaagaaggagaucaaggacuacugcgagauggcccucucccugagccagcggaucaagcaccuggacauccgcaucaagaagcgggacggcuccgaggacgcggacaacaaccucuucgaggggguggagaagcuggacgaguucuacgaccgccuguucgagaucguggacgagcacaacgccuaccaguaccaccacgaguuccaggccuuccucaccaagaagcccuacaagaccgacaaguucaagcugagcuucgacaacccgcagcugcucaagggcugggaccugaacaaggagcccgacuacuucggggcccugcuggucaagaacgagaaguacuuccucgccguguuccacaagcaguacgcgaacgagaucuuccggcagaagaacaagaacuccaccgugaagaucaaggaggccuacgacgucuucaacggcaacuacuacaagaagguggagcugaagcagauccccaagcuguucaugaaccucccccgcaucugcuucgccaagagcaaccaggaggaguucggccugacgaucgagcuggagaagaucaaguccgaguucgacaaguuccagaagcucaagaaggagcggcaggacaacaaccugaaguucgaccaggagaaguucaucaagcugcucgccuacuaccgccacugccuggagauccgggaggacuggaagguguucaaguacaacuucaagccgcuguacaaguacagcaaccucggggaguucuaccgcgaccuggagaaggacaccuacaaccuggaccucguccgggugaacuccgaguacguggagaagaagcgcaacgagggcaagcuguaccuguucgaggucuacaacaaggacuucagcgacaaguccaucgggcgcaagaacauccacagcgacuacuucaagucccucuuccugcccgacaaccugaccaacaagaagaucgcccucgcggccgacgccgagaucuucuuccgggagaagucccugaagaacaaggacgagaucaucacccagaagaacaagaucaagaucgacaagaacaaccacaagggcgagaaggccuacagcaagaaccgcuacacggacgacaagaucauccugcaccuccccaucaaccugaacuucggggagaacaagaaccacaaggacuucaacuacgagaucaacgacagccugcucaagaacaaccgggacaucaagaucaucggcaucgaccgcggcgagaaguaccugcuguacuacuccgugaucgaccagaagggggacaucaaggagaugggcgacuucaacguggucaacgggguggacuacuacagcaagcucgucgccuacgaggagaagcggaagcaggcgcgccuggacuggggcgacauccagagcaucaaggagcugaaggagggguacaucucccacgugauccacgagaucugcgaccucaucaagaaguacaacgccaucgugguccuggaggaccugagcaugggcuucaagcggggccgcuucuuccgggagcgccagguguaccagaaguucgagcucgcccuguuccggaagcugaacuacuggguggacaagaacaaggaggagggggagaagggcuccgcccucagcgcguggcagcugacccccaacgagaaggacuucaaggucucccagcuggagaaggcccgccagcucgggauccuguucuacaccgccgccggcuacaccagcaagacgugcccggacugcggguuccggaagaacaucacccugaaguacgugaacgacaagcagcucaaggaggaccugggcaagcugaagaucaacuucguggaggaccacuucaagaucaaguacaaccuccuggacuucgagaagaacaagaaguccgagaaggccaaggacaccguccugcccaaggaggagcgcaagaucagcuucguggcgaacuccaaggugauccggauccgcuggcacgacaucaagaccaagcucgccaagcgggagcuggacggcgagaagaucaucaagaaguuccccaagggggucaucaaggaguacgacaucaacaucugccugaagcgcaucaucggcgacaagaucgacuucagcaaggacuccaucacggagcagcucaucaacgggcgguucggcaaggacuucuacugggagcugauguacuuccugaaccucauccuggagauccgcaacguggugagcgagaccgagaucgacuacauccagugccccgucugcggcuuccacuccgacgacggguuccgcggcaacaaguucaacggggacgccaacggcgccuacaacaucgcccggaaggggcgccugauccucgagaagaucaaccagcacaagaaccugaaggagcugaagaccggcgaccucagcgugaacaucguggagugggacaaggcggucaacaacugggacaaguucgugcagggcgacaacaccgaguccaagaacaucgagaucccggccaaggaggagaugaucagcguggagguccgggaguccuga

SEQ ID NO: 2312 - RNA, 4107 nt, Artificial Sequence
  Cpf1 variant
augaagaaggagaaggaguucaagagcuucggcgacuucaccaaccuguacgagaucuccaagacccuccgcuucgagcugaagcccguggagaacacgcagaccaugcuggacgaggccgacgucuucgggaaggacaaggugaucaaggacaaguacaccaagaccaagccguucaucgacaagcuccaccgggaguucguggacgagagccugaaggacgucucccugagcggccucaagaaguacuccgaggugcuggagaacuggaagaagaacaagaaggacaaggacaucgugaaggagcugaagaaggaggaggagcgccuccggaaggaggucguggaguucuucgacaacacggccaagaagugggcgaacgagaaguacaaggagcuggggcugaagaagaaggacaucggcauccucuucgaggagagcguguucgaccugcugaaggagaaguacggggaggagcaggacuccuuccucaaggaggagaagggcgacuuccugaagaacgagaagggcgagaaggucagcaucuucgacgaguggaagggguucgugggcuacuucaccaaguuccaggagacccgcaagaacuucuacaagaacgacgggaccgagacggcccuggccacccggaucaucgaccagaaccucaagcgcuucugcgacaacaucgacgacuucaagaagaucaagaacaagaucgacuucuccgagguggagaagaacuucaacaagaccgccgacgucuucagccuggacuucuacaaccagugccugcuccagaagggcaucgacuccuacaacgaguucaucgggggcaagacccuggagaacggcaagaagcugaagggggugaacgagcucgugaacgaguaccggcagaagaacaagaacgagaaggucagcuuccugaagcugcucgacaagcagauccuguccgagaaggagaagcugagcuucggcaucgagaacgacgagcagcuccugguggugcugaacuccuucuacgagacggccgaggagaagaccaagauccuccgcacccuguucggggacuucgucgagcacaacgagaacuacgaccuggacaagaccuacaucagcaagguggcguucaacacgaucucccacaaguggaccaacgagacccacaaguucgaggagcuccuguacggcgccaugaaggaggacaagcccaucggccugaacuacgacaagaaggaggacagcuacaaguuccccgacuucaucgcccucggguaccugaagaagugccugaacaaccucgacugcgacaccaaguucuggaaggagaaguacuacgagaacaacgccgacaagaaggacaaggacaagggcuuccugaccgggggccagaacgcgugggaccaguuccugcagaucuucaucuucgaguucaaccagcuguucaacuccgaggccuucgacaacaaggggaaggagaucaagaucggcuacgacaacuuccggaaggacuucgaggagaucaucaaccagaaggacuucaagaacgacgagaaccucaagaucgccaucaagaacuucgccgacagcgugcuguggaucuaccagauggccaaguacuucgcgaucgagaagaagcgcggcugggacgacgacuucgagcucagcgaguucuacacgaaccccuccaacggguacagccuguucuacgaccgggccuacgaggagaucguccagaaguacaacgaccugcgcaacuaccugaccaagaagccguacaaggaggacaaguggaagcucaacuucgagaaccccacccuggccaacggcuucgacaagaacaaggaguccgacaacagcacggugauccugcggaagaagcgcaaguacuaccucgggcugaugaagaagggcaacaacaagaucuucgaggaccggaacaaggccgaguucauccgcaacaucgaguccggggccuacgagaagauggcguacaaguaccugcccgacguggccaagaugauccccaagugcagcacccagcucaacgaggccaagaaccacuuccggaacuccgccgacgaccuggagaucaagaaguccuucagcaacccgcugaagaucaccaagcgcaucuucgaccucaacaacauccaguacgacaagaccaacgucagcaagaagaucuccggcgacaacaagggcaucaagaucuuccagaaggaguacuacaagaucagcggggacuucgacguguacaaguccgcccugaacgacuggaucgacuucugcaaggacuuccugagcaaguacgacuccacgaaggacuucgacuucagcauccuccggaagaccaaggacuacaagucccuggacgaguucuacgucgacguggcgaagaucaccuacaagaucagcuucacccccguguccgagagcuacaucgaccagaagaacaagaacggcgagcuguaccucuucgagaucuacaaccaggacuucgccaaggggaagaugggcgccaagaaccugcacacgcuguacuucgagaacgucuucagccccgagaacaucuccaagaacuuccccaucaagcucaacgggaacgccgagcuguucuuccgccccaagagcaucgaguccaagaaggagaagcggaacuucgugcgcgagaucgugaacaagaagcgcuacagcgaggacaagaucuucuuccacugcccgaucacccugaaccgggagaccggcuccaucuaccgcuucaacaacuacgucaacaacuuccucagcgagaacaacaucaacaucaucggcguggaccgcggggagaagcaccuggccuacuacuccgugaucgacaagaacggcgucaagaucgggggcggcagcuucaacgagaucaacaagguggacuacgcgaagaagcuggaggagcgggccggggagcgggagcagucccgcaaggacuggcaggucguggagggcaucaaggaccucaagaagggguacaucagccagguggugcgggagcuggccgaccuggccaucaagcacaacgcgaucaucguccucgaggaccugaacaugcgcuucaagcagauccggggcgggaucgagaaguccaucuaccagcagcuggagaaggcccucaucgacaagcugagcuuccugguggagaagggcgagaaggaccccaaccaggccggccacauccucaaggccuaccagcuggccgcgcccuucaccuccuucaaggacauggggaagcagacgggcaucguguucuacacccaggccagcuacaccuccaagaccugcccgaacugcggguuccgcaagaacaacaacaaguucuacuucgagaacaacaucggcaaggcccaggacgcccugaagaagcucaagaccuucgaguacgacagcgagaacaagugcuucgggcuguccuacugccugagcgacuucgccaacaaggaggaggucgagaagaacaagaacaagaagcggaacaacgcgcccuacagcgacaucgagaagaaggacugcuucgagcucuccacgaaggacgccgugcgcuaccgguggcacgacaagaacaccgagcgcggcaagaccuucuucgagggcgagagcguguacgaggagaaggaggagaaggagaucgggcagaccaagcggggccuggucaaggaguacgacaucuccaagugccugaucggccucuucgagaagacggggcuggacuacaagcagaaccugcucgacaagaucaacagcgggaaguucgacggcaccuucuacaagaaccuguucaacuaccugaaccuccuguucgagauccgcaacuccaucagcggcaccgagaucgacuacaucuccugccccgagugccaguuccacaccgacaagagcaagacgaucaagaacggggacgacaacggcuccuacaacaucgcccggaaggggaugaucauccuggacaagaucaagcaguucaagaaggagaacggcagccucgacaagaugggguggggcgagcuguucaucgaccuggaggagugggacaaguucgcccagaagaagaacaacaacaucaucgacaaguga

SEQ ID NO: 2313 - RNA, 4149 nt, Artificial Sequence
  Cpf1 variant
augagcaagaacaacgugugggacaaguucaccaaccaguacucccugagcaagacccuccgcuucgagcugaagcccgucggcaagacgcgggagaagaugaacgagcagcugaaguacgacaagcagcuccagaccuuccugaaggaccaggagaucgaggacgccuaccaguaccugaagccguucuucgacaagcuccacaaggaguucaucaccgacucccuggacagcgacaccacgaagaagaucgacuucuccgacuaccugaucgacuaccgcgacaagaaggaccucaccaagaaggaggacagccugcggaagaacaucggggagguguucgugaaggccggcgaccgcuggaagaaggagaaguaccccaaguacgaguggaagaagggguccaacgucgcgaacggcagcgggauccugcucacccaggacgugcugaugcugaucaaggaccucaaccccaacgaccagaagaucaagaagaugaucgaggagaccuucaagggcuucuucacguacuucuccggcuucaaccugaaccgggagaacuacuacaccaccaagguggagaaggccaccgccgucgccacgcgcaucgugcacgacaaccugcccaaguucugcgacaaccucgugcaguucgagugcaucaucaagaagaagaagaacggggaggucgaccggaucgagcgcaagagcgaguaccugaacgccuaccaguaccugaaguccaagggccggaccacccagaucaaggacgcggagagcgggaagaugaucgaggccgaggugaucaacgagaacauguucuccaucagcuacuucuccgccugccucagccaguccggcaucgaggaguacaaccgcaccaucgggcacuacaaccugcugaucaaccucuacaaccaggccaaggagggcgaggagaaggaccugaagaaguccgagaagaaguucaagcggcugccgaucuucaagacgcucuacaagcagaucggcugcggggagaaggagccccuguucuucagccugacccacgacaccaagcuccaggugcaggagaacaaggagaacuacaagaagcccuacagcgucgagcagauccuggagcaggcgaagcuggccggcgacaaguacuucaagggcaagagcaacgacgggauccucaacaccauccccgaguucuccgacuacauccugcagaaggagagcuacggcgggguguacugguccaagguggccaucaacacgaucagcaaccgcuacuucgagaacuggcacacccugaaggacgcccucaucgacgccaaggucuucgagaagggcaagaagggggacgaggaggacgugaagaucccggaguccaucgagcugcagggcuucuucgacgugcuggacacccaggagggguggaaguccgagggcaucuucuucaagaagucccucaccgaggagcugaagaacaaggaggcggacacgaagaacaagaagcggcgcgagaucgucaaggaggccaagcggcccagccaggcccugcucgcccugcuguucgacgacauccaggagcacgccaaccucuuccugaaccagagcgacgagauccugaagcucgagaaguacagcgagaaggaguccaaggagaagaucaagcaguggauggacagcgcgcuggccgugaaccgcauccugaaguacuucuucgugaaggaguccaaggccaagggcgagcagaucgaccccaucaucagcgaggcccugaagguccucuucaacuccgaggacgccaccugguucaagugguacgacgcgcugcggaacuaccugaccaagaagccccaggacgacgugaaggagaacaagcucaagcugaacuucgagaacagcacccuggccgggggcugggacaucaacaaggaguccgacaacuacugcgugauccuccaggaccagaaggggaagcagcaccugggcaucaucgccaagaaggagaagcagcgcggguacaacaagaucuucgagcggacgccggagaacccccuguacaagaucgacagcggcgaggucuggcagaagauggaguacaagcagaucgccgugcccaccggcaucgggggcuucguccgcaagugcuucaacaccgcccagcaguacggguggaagugccccgacaacugccucaacuccgagggcaagaucaucaucaagaacgacgaggcgaaggagaaccuggaggccaucaucgacugcuacaaggacuucuucaccaaguacgagaaggacggguucaaguacaagaacuucaacuucaacuucaaggagagcgaggaguacgaggagcugaacagcuucuucuccgacguggagcggcagggcuacaagcucggcuucaucacggugaacaagaccaucaucgacaagugggucgaggacgggaccaucuaccuguucgagaucaagaaccaggacaccaacgacggcaagaaggacgggcacaagaacaaccugcacacgaucuacuggaaggcccucuucgaggacgugggcaacaagccgaagcugaacggcggggccgagcuguucuaccgcaaggcgcuccugaaggacaagcaggagaagaucgaggacaacuacggcaaggagaucaucaagaacuuccgcuucagcaaggagaaguuccuguuccacugccccaucaagcucaacuacaaggccaaguccuacagccaccccaaguacgcccugcccgagaucaacaagcagaccaacgaguucuucaucaccaucuccgacaucugcuuccuggggaucgaccggggcgagaagcaccucgccuacuacagccuggugaaccagaaggaggagaucaucgaccaggggacccugaacaugccguucgucgacaaggacggcaagccccgcuccaucaagaaggagaaguuccgguucgacgccaagguggacaagugggugagcgaggagauggacugcuggaacuacaacgaccuccuggacgcgauggccuccaaccgcgacauggcccggaagaacuggcagaccaucggcacgaucaaggagcugaagaacggguacaucagccaggucgugcgcaagaucguggaccucgccaucgacaagaaccggggcauccccuccuucaucguccuggagaaccugaacgccggguucaugcgcggccggcagaagaucgagaaguccguguaccagaagcucgagcuggcgcuggccaagaagcucaacuucguggucgacaagaccgugcagaacggggagaucggcagcgugaccaacgcccugcagcugacgcccccggucaccaacuuccagaacaucgagaaccgcaagcaggucggcaucaugcucuacacccgggccgacuacaccagccagaccgaccccgugacgggguggcgcaaguccaucuaccugaagaagggcagcgaggaguacaucaagucccagaucauggacagcuucgacgacuucggguucgacggcaagaacuacuacuucaaguacaccguggaccugaucgaccccaucaagaagaccagcgagaagaaguucaagaagcaguggacccucuacuccgggaucaacggcaagagccuggaccgguuccgcggcgagcgguccagcgacaagaacguguggaucaagacgcugcaggacaucaagaccacccucgacgccguguucaucggguucgaccugcagcacucccugcgcagccagaucaucaacgacggcaucaugcccaagaagaucgagaacucccaguucaccgggugggagagccuccgguucgcgaucgagaugauccagcagauccgcaacaucggcgucgagaagggggacgaggacuucauccuguccccggugcgggacaagaacgagaaccacuucgacagccgcaaggccaaggagaacgagcccaacuccggcgacgccaacggcgccuacaacaucgcgcgcaaggggaucaucaugaacgagcacaucaagaaggaccugauccccuucauccaggacaaggagugggacgccuggcucgccggccgggaggugugggacaaguggcugaucgagaacaaggacagccugaucuacaagaaguga

SEQ ID NO: 2314 - RNA, 4206 nt, Artificial Sequence
  Cas9 variant mRNA product
auggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaauga

SEQ ID NO: 2315 - RNA, 4989 nt, Artificial Sequence
  Cas9 variant mRNA product
auggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaauga

SEQ ID NO: 2316 - RNA, 3261 nt, Artificial Sequence
  Cas9 variant mRNA product
auggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaauga

SEQ ID NO: 2317 - RNA, 4329 nt, Artificial Sequence
  Cas9 variant mRNA product
auggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaauga

SEQ ID NO: 2318 - RNA, 3405 nt, Artificial Sequence
  Cas9 variant mRNA product
auggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaauga

SEQ ID NO: 2319 - RNA, 4266 nt, Artificial Sequence
  Cas9 variant mRNA product
auggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaauga

SEQ ID NO: 2320 - RNA, 3348 nt, Artificial Sequence
  Cas9 variant mRNA product
auggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaauga

SEQ ID NO: 2321 - RNA, 4104 nt, Artificial Sequence
  Cas9 variant mRNA product
auggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaauga

SEQ ID NO: 2322 - RNA, 4137 nt, Artificial Sequence
  Cas9 variant mRNA product
auggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaauga

SEQ ID NO: 2323 - RNA, 3270 nt, Artificial Sequence
  Cas9 variant mRNA product
auggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaauga

SEQ ID NO: 2324 - RNA, 3348 nt, Artificial Sequence
  Cas9 variant mRNA product
auggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaauga

SEQ ID NO: 2325 - RNA, 3354 nt, Artificial Sequence
  Cas9 variant mRNA product
auggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaauga

SEQ ID NO: 2326 - RNA, 3054 nt, Artificial Sequence
  Cas9 variant mRNA product
auggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaauga

SEQ ID NO: 2327 - RNA, 3465 nt, Artificial Sequence
  Cas9 variant mRNA product
auggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaauga

SEQ ID NO: 2328 - RNA, 4023 nt, Artificial Sequence
  Cpf1 variant mRNA product
auggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaauga

SEQ ID NO: 2329 - RNA, 4002 nt, Artificial Sequence
  Cpf1 variant mRNA product
auggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaauga

SEQ ID NO: 2330 - RNA, 4716 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2331 - RNA, 5499 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2332 - RNA, 3771 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2333 - RNA, 4839 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2334 - RNA, 3915 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2335 - RNA, 4776 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2336 - RNA, 3858 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2337 - RNA, 4614 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2338 - RNA, 4647 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2339 - RNA, 3780 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2340 - RNA, 3858 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2341 - RNA, 3864 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2342 - RNA, 3564 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2343 - RNA, 3975 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2344 - RNA, 4533 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2345 - RNA, 4512 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2346 - RNA, 4813 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2347 - RNA, 5596 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2348 - RNA, 3868 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2349 - RNA, 4936 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2350 - RNA, 4012 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2351 - RNA, 4873 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2352 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2353 - RNA, 4711 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2354 - RNA, 4744 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2355 - RNA, 3877 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2356 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2357 - RNA, 3961 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2358 - RNA, 3661 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2359 - RNA, 4072 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2360 - RNA, 4630 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2361 - RNA, 4609 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 2362 - RNA, 4497 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2363 - RNA, 5280 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2364 - RNA, 3552 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2365 - RNA, 4620 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2366 - RNA, 3696 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2367 - RNA, 4557 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2368 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2369 - RNA, 4395 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2370 - RNA, 4428 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2371 - RNA, 3561 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2372 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2373 - RNA, 3645 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2374 - RNA, 3345 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2375 - RNA, 3756 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2376 - RNA, 4314 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2377 - RNA, 4293 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2378 - RNA, 4439 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2379 - RNA, 5222 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2380 - RNA, 3494 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2381 - RNA, 4562 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2382 - RNA, 3638 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2383 - RNA, 4499 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2384 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2385 - RNA, 4337 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2386 - RNA, 4370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2387 - RNA, 3503 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2388 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2389 - RNA, 3587 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2390 - RNA, 3287 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2391 - RNA, 3698 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2392 - RNA, 4256 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2393 - RNA, 4235 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2394 - RNA, 4420 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2395 - RNA, 5203 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2396 - RNA, 3475 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2397 - RNA, 4543 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2398 - RNA, 3619 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2399 - RNA, 4480 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2400 - RNA, 3562 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2401 - RNA, 4318 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2402 - RNA, 4351 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2403 - RNA, 3484 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2404 - RNA, 3562 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2405 - RNA, 3568 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2406 - RNA, 3268 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2407 - RNA, 3679 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2408 - RNA, 4237 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2409 - RNA, 4216 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2410 - RNA, 4530 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2411 - RNA, 5313 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2412 - RNA, 3585 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2413 - RNA, 4653 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2414 - RNA, 3729 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2415 - RNA, 4590 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2416 - RNA, 3672 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2417 - RNA, 4428 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2418 - RNA, 4461 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2419 - RNA, 3594 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2420 - RNA, 3672 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2421 - RNA, 3678 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2422 - RNA, 3378 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2423 - RNA, 3789 nt, Artificial Sequence
  Cas9 variant mRNA product
gggagaggcgcugccuacggagguggcagccaucuccuucucggcaucaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2424 - RNA, 4347 nt, Artificial Sequence
  Cpf1 variant mRNA product
gggagaggcgcugccuacggagguggcagccaucuccuucucggcaucaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2425 - RNA, 4326 nt, Artificial Sequence
  Cpf1 variant mRNA product
gggagaggcgcugccuacggagguggcagccaucuccuucucggcaucaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2426 - RNA, 4582 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2427 - RNA, 5365 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2428 - RNA, 3637 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2429 - RNA, 4705 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2430 - RNA, 3781 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2431 - RNA, 4642 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2432 - RNA, 3724 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2433 - RNA, 4480 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2434 - RNA, 4513 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2435 - RNA, 3646 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2436 - RNA, 3724 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2437 - RNA, 3730 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2438 - RNA, 3430 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2439 - RNA, 3841 nt, Artificial Sequence
  Cas9 variant mRNA product
ggggcgcugccuacggagguggcagccaucuccuucucggcaucaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2440 - RNA, 4399 nt, Artificial Sequence
  Cpf1 variant mRNA product
ggggcgcugccuacggagguggcagccaucuccuucucggcaucaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2441 - RNA, 4378 nt, Artificial Sequence
  Cpf1 variant mRNA product
ggggcgcugccuacggagguggcagccaucuccuucucggcaucaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2442 - RNA, 4484 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2443 - RNA, 5267 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2444 - RNA, 3539 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2445 - RNA, 4607 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2446 - RNA, 3683 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2447 - RNA, 4544 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2448 - RNA, 3626 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2449 - RNA, 4382 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2450 - RNA, 4415 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2451 - RNA, 3548 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2452 - RNA, 3626 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2453 - RNA, 3632 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2454 - RNA, 3332 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2455 - RNA, 3743 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2456 - RNA, 4301 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2457 - RNA, 4280 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2458 - RNA, 4581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2459 - RNA, 5364 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2460 - RNA, 3636 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2461 - RNA, 4704 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2462 - RNA, 3780 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2463 - RNA, 4641 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2464 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2465 - RNA, 4479 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2466 - RNA, 4512 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2467 - RNA, 3645 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2468 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2469 - RNA, 3729 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2470 - RNA, 3429 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2471 - RNA, 3840 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2472 - RNA, 4398 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2473 - RNA, 4377 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 2474 - RNA, 4517 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2475 - RNA, 5300 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2476 - RNA, 3572 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2477 - RNA, 4640 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2478 - RNA, 3716 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2479 - RNA, 4577 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2480 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2481 - RNA, 4415 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2482 - RNA, 4448 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2483 - RNA, 3581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2484 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2485 - RNA, 3665 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2486 - RNA, 3365 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2487 - RNA, 3776 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2488 - RNA, 4334 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2489 - RNA, 4313 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2490 - RNA, 4466 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2491 - RNA, 5249 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2492 - RNA, 3521 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2493 - RNA, 4589 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2494 - RNA, 3665 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2495 - RNA, 4526 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2496 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2497 - RNA, 4364 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2498 - RNA, 4397 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2499 - RNA, 3530 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2500 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2501 - RNA, 3614 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2502 - RNA, 3314 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2503 - RNA, 3725 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2504 - RNA, 4283 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2505 - RNA, 4262 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 2506 - RNA, 4452 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2507 - RNA, 5235 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2508 - RNA, 3507 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2509 - RNA, 4575 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2510 - RNA, 3651 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2511 - RNA, 4512 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2512 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2513 - RNA, 4350 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2514 - RNA, 4383 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2515 - RNA, 3516 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2516 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2517 - RNA, 3600 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2518 - RNA, 3300 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2519 - RNA, 3711 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2520 - RNA, 4269 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2521 - RNA, 4248 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2522 - RNA, 4433 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggacaagaaguacagcaucggccuggacaucgggaccaacuccgugggcugggccgugaucaccgacgaguacaagguccccagcaagaaguucaaggugcuggggaacacggaccggcacuccaucaagaagaaccugaucggcgcccugcuguucgacagcggcgagaccgccgaggccacccgccugaagcggaccgcgcgccggcgcuacacgcggcgcaagaaccggaucugcuaccugcaggagaucuucuccaacgagauggccaagguggacgacagcuucuuccaccgccucgaggaguccuuccuggucgaggaggacaagaagcacgagcggcaccccaucuucgggaacaucguggacgagguggccuaccacgagaaguaccccaccaucuaccaccuccgcaagaagcucgucgacagcaccgacaaggccgaccugcggcugaucuaccucgcgcuggcccacaugaucaaguuccgcggccacuuccugaucgagggggaccucaacccggacaacuccgacguggacaagcuguucauccagcuggugcagaccuacaaccagcuguucgaggagaaccccaucaacgccagcggcgucgacgccaaggccauccuguccgcgcggcugagcaagucccgccggcucgagaaccugaucgcccagcugcccggggagaagaagaacggccucuucggcaaccugaucgcccugagccucgggcugacgcccaacuucaaguccaacuucgaccuggccgaggacgccaagcuccagcugagcaaggacaccuacgacgacgaccuggacaaccuccuggcgcagaucggcgaccaguacgccgaccuguuccucgccgccaagaaccuguccgacgccauccugcucagcgacauccugcgcgugaacaccgagaucaccaaggcgccgcuguccgccagcaugaucaagcgguacgacgagcaccaccaggaccucacgcugcugaaggcccucgugcgccagcagcugcccgagaaguacaaggagaucuucuucgaccagagcaagaacggguacgccggcuacaucgacggcggggccucccaggaggaguucuacaaguucaucaagcccauccuggagaagauggacggcaccgaggagcuccuggucaagcugaaccgggaggaccugcuccgcaagcagcgcaccuucgacaacgggagcaucccccaccagauccaccugggcgagcugcacgcgauccuccggcgccaggaggacuucuacccguuccugaaggacaaccgggagaagaucgagaagauccugaccuuccgcauccccuacuacguggggccccucgcccggggcaacucccgcuucgccuggaugacgcgcaagagcgaggagaccaucacccccuggaacuucgaggagguggucgacaagggcgccuccgcgcagagcuucaucgagcggaugaccaacuucgacaagaaccugccgaacgagaaggugcugcccaagcacucccuccuguacgaguacuucacgguguacaacgagcugaccaaggucaaguacgugaccgaggggaugcggaagcccgccuuccucagcggcgagcagaagaaggccaucguggaccugcuguucaagaccaaccgcaaggucacggugaagcagcucaaggaggacuacuucaagaagaucgagugcuucgacuccgucgagaucagcgggguggaggaccgguucaacgccucccugggcaccuaccacgaccugcucaagaucaucaaggacaaggacuuccuggacaacgaggagaacgaggacauccuggaggacaucgugcucacccugacccuguucgaggaccgcgagaugaucgaggagcggcucaagacguacgcccaccuguucgacgacaaggucaugaagcagcugaagcgccggcgcuacaccggguggggccggcucagccgcaagcugaucaacggcauccgggacaagcaguccgggaagaccauccuggacuuccucaagagcgacggcuucgcgaaccgcaacuucaugcagcugauccacgacgacucccugaccuucaaggaggacauccagaaggcccaggugagcgggcagggcgacucccuccacgagcacaucgccaaccuggccgggagccccgccaucaagaagggcauccugcagacggugaaggucguggacgagcucgugaaggucaugggccgccacaagccggagaacaucgugaucgagauggcgcgggagaaccagaccacccagaaggggcagaagaacucccgcgagcggaugaagcgcaucgaggagggcaucaaggagcuggggagccagauccugaaggagcaccccguggagaacacccagcuccagaacgagaagcuguaccuguacuaccuccagaacggccgggacauguacgucgaccaggagcuggacaucaaccgccugagcgacuacgacguggaccacaucgugccccaguccuuccucaaggacgacagcaucgacaacaagguccugacgcgguccgacaagaaccgcggcaagagcgacaacgugcccuccgaggagguggucaagaagaugaagaacuacuggcggcagcugcucaacgccaagcugaucacccagcgcaaguucgacaaccugaccaaggccgagcgcgggggccucagcgagcuggacaaggccggguucaucaagcggcagcugguggagacccggcagaucaccaagcacguggcccagauccucgacucccgcaugaacacgaaguacgacgagaacgacaagcugauccgggaggucaaggugaucacccucaagagcaagcucguguccgacuuccgcaaggacuuccaguucuacaagguccgggagaucaacaacuaccaccacgcgcacgacgccuaccugaacgccguggugggcaccgcccugaucaagaaguacccgaagcucgagagcgaguucgucuacggggacuacaagguguacgacgugcgcaagaugaucgcgaaguccgagcaggagaucggcaaggccaccgccaaguacuucuucuacagcaacaucaugaacuucuucaagacggagaucacccuggccaacggcgagauccggaagcgcccccugaucgagaccaacggggagaccggcgagaucgucugggacaaggggcgggacuucgccacggugcgcaaggugcucuccaugccccaggucaacaucgugaagaagaccgaggugcagaccggcggguucagcaaggaguccauccugcccaagcgcaacagcgacaagcugaucgcgcggaagaaggacugggacccgaagaaguacggcggcuucgacucccccaccgucgccuacagcgugcucguggucgccaagguggagaagggcaagagcaagaagcugaaguccgugaaggagcugcucgggaucacgaucauggagcgcagcuccuucgagaagaaccccaucgacuuccuggaggccaagggguacaaggaggucaagaaggaccugaucaucaagcucccgaaguacagccuguucgagcuggagaacggccggaagcgcaugcucgccuccgcgggggagcugcagaagggcaacgagcuggcccuccccagcaaguacgugaacuuccuguaccuggccucccacuacgagaagcucaagggcagccccgaggacaacgagcagaagcagcuguucguggagcagcacaagcacuaccuggacgagaucaucgagcagaucuccgaguucagcaagcgggucauccucgccgacgccaaccuggacaaggugcuguccgcguacaacaagcaccgcgacaagcccauccgggagcaggccgagaacaucauccaccucuucacccugaccaaccugggggccccggccgcguucaaguacuucgacaccacgaucgaccgcaagcgguacaccagcaccaaggaggugcucgacgccacccugauccaccaguccaucacgggccuguacgagacccgcaucgaccucagccagcucgggggcgacaagcggcccgccgccaccaagaaggccgggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2523 - RNA, 5216 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaacuucaagauccugcccaucgccaucgaccucggcgugaagaacaccgggguguucagcgccuucuaccagaagggcaccucccuggagcggcuggacaacaagaacgggaaggucuacgagcucagcaaggacuccuacacgcugcugaugaacaaccgcaccgcccggcgccaccagcggcgcggcaucgaccggaagcagcucgugaagcgccuguucaagcugaucuggaccgagcagcucaaccuggagugggacaaggacacccagcaggccaucagcuuccuguucaaccggcgcggcuucuccuucaucacggacggguacagccccgaguaccucaacaucgugcccgagcaggucaaggcgauccugauggacaucuucgacgacuacaacggcgaggacgaccuggacuccuaccucaagcuggccaccgagcaggagagcaagaucuccgagaucuacaacaagcugaugcagaagauccucgaguucaagcugaugaagcugugcaccgacaucaaggacgacaaggugagcaccaagacgcucaaggagaucaccuccuacgaguucgagcugcuggccgacuaccucgccaacuacagcgagucccugaagacccagaaguucagcuacaccgacaagcaggggaaccugaaggagcucuccuacuaccaccacgacaaguacaacauccaggaguuccugaagcggcacgcgacgaucaacgaccgcauccuggacacccuccugaccgacgaccuggacaucuggaacuucaacuucgagaaguucgacuucgacaagaacgaggagaagcuccagaaccaggaggacaaggaccacauccaggcccaccuccaccacuucguguucgccgucaacaagaucaagagcgagauggccuccggcgggcggcaccgcagccaguacuuccaggagaucaccaacgugcuggacgagaacaaccaccaggagggcuaccugaagaacuucugcgagaaccugcacaacaagaaguacuccaaccugagcgugaagaaccucgucaaccugaucggcaaccugagcaaccucgagcugaagccgcugcggaaguacuucaacgacaagauccacgccaaggcggaccacugggacgagcagaaguucacggagaccuacugccacuggauccucggggaguggcgcgugggcgugaaggaccaggacaagaaggacggggccaaguacuccuacaaggaccugugcaacgagcugaagcagaaggucaccaaggccggccucguggacuuccugcuggagcuggaccccugccggaccaucccgcccuaccucgacaacaacaaccgcaagccgcccaagugccagagccugauccugaaccccaaguuccucgacaaccaguaccccaacuggcagcaguaccugcaggagcugaagaagcuccaguccauccagaacuaccuggacagcuucgagacggaccugaaggugcucaaguccagcaaggaccagcccuacuucgucgaguacaaguccagcaaccagcagaucgccuccggccagcgggacuacaaggaccuggacgcccgcauccugcaguucaucuucgaccgggugaaggcgagcgacgagcuccugcugaacgagaucuacuuccaggccaagaagcucaagcagaaggccuccagcgagcuggagaagcuggaguccagcaagaagcucgacgaggugaucgccaacucccagcugagccagauccugaagucccagcacaccaacgggaucuucgagcagggcaccuuccuccaccuggucugcaaguacuacaagcagcgccagcgcgcccgggacagccgccuguacaucaugcccgaguaccgguacgacaagaagcuccacaaguacaacaacaccgggcgcuucgacgacgacaaccagcugcugacguacugcaaccacaagccccggcagaagcgcuaccagcuccugaacgaccuggcgggcgugcuccaggugucccccaacuuccugaaggacaagaucgggagcgacgacgaccuguucaucagcaaguggcucgucgagcacauccggggcuucaagaaggccugcgaggacucccugaagauccagaaggacaaccgcggccugcucaaccacaagaucaacaucgcccggaacaccaaggggaagugcgagaaggagaucuucaaccugaucugcaagaucgagggcagcgaggacaagaaggggaacuacaagcacggccuggccuacgagcucggggugcugcuguucggcgagccgaacgaggccuccaagcccgaguucgaccgcaagaucaagaaguucaacagcaucuacuccuucgcgcagauccagcagaucgccuucgccgagcggaagggcaacgccaacacgugcgcggucugcagcgccgacaacgcccaccgcaugcagcagaucaagaucaccgagcccguggaggacaacaaggacaagaucauccucuccgccaaggcccagcggcugcccgcgaucccgacccgcaucguggacggggccgucaagaagauggccaccauccuggccaagaacaucguggacgacaacuggcagaacaucaagcagguccucagcgccaagcaccagcugcacauccccaucaucaccgaguccaacgcguucgaguucgagcccgcccuggccgacgugaagggcaagagccucaaggaccggcgcaagaaggcccuggagcggaucucccccgagaacaucuucaaggacaagaacaaccgcaucaaggaguucgccaaggggaucagcgcguacuccggcgccaaccugaccgacggggacuucgacggcgccaaggaggagcucgaccacaucaucccgcggagccacaagaaguacggcacgcugaacgacgaggccaaccugaucugcgugacccgcggggacaacaagaacaagggcaaccgcaucuucugccuccgggaccuggcggacaacuacaagcugaagcaguucgagaccaccgacgaccucgagaucgagaagaagaucgccgacacgaucugggacgccaacaagaaggacuucaaguucgggaacuaccgcuccuucaucaaccugacgccccaggagcagaaggccuuccggcacgcccuguuccucgcggacgagaaccccaucaagcaggccgugauccgcgccaucaacaaccggaaccgcaccuucgucaacggcacccagcgguacuucgccgaggugcuggccaacaacaucuaccugcgcgcgaagaaggagaaccucaacaccgacaagaucagcuucgacuacuucggcauccccaccaucgggaacggccgggggaucgccgagauccgccagcuguacgagaagguggacuccgacauccaggccuacgccaagggcgacaagccgcaggccagcuacagccaccugaucgacgcgaugcucgccuucugcaucgccgccgacgagcaccggaacgacggguccaucggccuggagaucgacaagaacuacagccuguacccccucgacaagaacaccggcgaggucuucaccaaggacaucuucucccagaucaagaucaccgacaacgaguucagcgacaagaagcuggugcgcaagaaggcgaucgagggguucaacacgcaccggcagaugacccgcgacggcaucuacgccgagaacuaccugcccauccucauccacaaggagcugaacgaggugcggaagggguacaccuggaagaacuccgaggagaucaagaucuucaagggcaagaaguacgacauccagcagcugaacaaccucgucuacugccugaaguucguggacaagccgaucagcaucgacauccagaucuccacccuggaggagcuccgcaacauccugacgaccaacaacaucgccgccaccgccgaguacuacuacaucaaccugaagacccagaagcuccacgaguacuacaucgagaacuacaacacggcgcugggguacaagaaguacagcaaggagauggaguuccugcggucccucgccuaccgcagcgagcgggugaagaucaaguccaucgacgacgucaagcagguccuggacaaggacagcaacuucaucaucggcaagaucacccugcccuucaagaaggaguggcagcgccucuaccgggaguggcagaacaccaccaucaaggacgacuacgaguuccugaaguccuucuucaacgucaagagcaucacgaagcugcacaagaaggugcgcaaggacuucucccuccccaucagcaccaacgagggcaaguuccuggugaagcgcaagaccugggacaacaacuucaucuaccagauccugaacgacuccgacagccgggccgacgggaccaagcccuucaucccggccuucgacaucuccaagaacgagaucguggaggccaucaucgacagcuucacgagcaagaacaucuucuggcuccccaagaacaucgagcugcagaagguggacaacaagaacaucuucgcgaucgacaccuccaagugguucgagguggagacccccagcgaccugcgcgacaucggcaucgccaccauccaguacaagaucgacaacaacucccggcccaaggugcgcgucaagcuggacuacgugaucgacgacgacagcaagaucaacuacuucaugaaccacucccuccucaagagccgguacccggacaaggugcuggagauccugaagcaguccacgaucaucgaguucgagagcuccggguucaacaagaccaucaaggagaugcugggcaugaagcuggccgggaucuacaacgagaccagcaacaacaagcgccccgccgccaccaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2524 - RNA, 3488 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagcggaacuacauccugggccucgacaucgggaucaccagcgugggcuacgggaucaucgacuacgagacccgcgacgugaucgacgccggcguccggcuguucaaggaggccaacguggagaacaacgagggccgccgguccaagcgcggggcccggcgccugaagcggcgccggcgccaccggauccagcgcgugaagaagcuccuguucgacuacaaccugcucacggaccacagcgagcuguccggcaucaaccccuacgaggcccgggucaaggggcugagccagaagcucuccgaggaggaguucagcgcggcccugcugcaccucgccaagcgccggggcgugcacaacgugaacgaggucgaggaggacaccgggaacgagcuguccaccaaggagcagaucagccgcaacuccaaggcccuggaggagaaguacguggcggagcuccagcuggagcggcugaagaaggacggcgaggugcgcggcagcaucaaccgguucaagaccuccgacuacgucaaggaggccaagcagcuccugaaggugcagaaggccuaccaccagcuggaccagagcuucaucgacacguacaucgaccuccuggagacccgccgcaccuacuacgaggggcccggcgaggggucccccuucggcuggaaggacaucaaggagugguacgagaugcugaugggccacugcaccuacuucccggaggagcuccggagcgugaaguacgccuacaacgccgaccuguacaacgcgcugaacgaccucaacaaccuggucaucacgcgcgacgagaacgagaagcuggaguacuacgagaaguuccagaucaucgagaacguguucaagcagaagaagaagcccacccucaagcagaucgccaaggagauccuggugaacgaggaggacaucaagggguaccgggucaccuccaccggcaagcccgaguucacgaaccugaagguguaccacgacaucaaggacaucaccgcccgcaaggagaucaucgagaacgccgagcuccuggaccagaucgccaagauccugaccaucuaccagagcuccgaggacauccaggaggagcucaccaaccugaacagcgagcugacgcaggaggagaucgagcagaucuccaaccucaagggguacaccggcacccacaaccugagccugaaggcgaucaaccucauccuggacgagcuguggcacaccaacgacaaccagaucgccaucuucaaccggcucaagcuggugcccaagaaggucgaccugagccagcagaaggagaucccgacgacccucguggacgacuucauccugucccccguggucaagcgcagcuucauccaguccaucaaggugaucaacgccaucaucaagaaguacgggcugcccaacgacaucaucaucgagcuggcccgggagaagaacagcaaggacgcccagaagaugaucaacgagaugcagaagcgcaaccggcagaccaacgagcgcaucgaggagaucauccggaccacgggcaaggagaacgcgaaguaccucaucgagaagaucaagcugcacgacaugcaggagggcaagugccuguacucccucgaggccaucccccuggaggaccugcucaacaacccguucaacuacgaggucgaccacaucaucccccgcagcguguccuucgacaacagcuucaacaacaaggugcuggucaagcaggaggagaacuccaagaaggggaaccggacccccuuccaguaccugagcuccagcgacuccaagaucagcuacgagaccuucaagaagcacauccucaaccuggccaagggcaaggggcgcaucuccaagaccaagaaggaguaccugcucgaggagcgggacaucaaccgcuucagcgugcagaaggacuucaucaaccggaaccugguggacacgcgcuacgccacccggggccugaugaaccuccugcgcuccuacuuccgcgucaacaaccuggacgugaaggucaagagcaucaacgggggcuucaccuccuuccuccggcgcaaguggaaguucaagaaggagcggaacaagggcuacaagcaccacgccgaggacgcgcugaucaucgccaacgccgacuucaucuucaaggaguggaagaagcuggacaaggccaagaaggugauggagaaccagauguucgaggagaagcaggcggagagcaugcccgagaucgagaccgagcaggaguacaaggagaucuucaucacgccgcaccagaucaagcacaucaaggacuucaaggacuacaaguacagccaccgcguggacaagaagcccaaccgggagcucaucaacgacacccuguacuccacccgcaaggacgacaaggggaacacccugaucgugaacaaccucaacggccuguacgacaaggacaacgacaagcugaagaagcucaucaacaagagccccgagaagcugcugauguaccaccacgacccccagacguaccagaagcucaagcugaucauggagcaguacggggacgagaagaacccgcuguacaaguacuacgaggagaccggcaacuaccucaccaaguacuccaagaaggacaacgggcccgucaucaagaagaucaaguacuacggcaacaagcugaacgcccaccuggacaucaccgacgacuaccccaacagccggaacaagguggugaagcucucccugaagcccuaccgcuucgacgucuaccuggacaacggcguguacaaguucgugaccgucaagaaccucgacgugaucaagaaggagaacuacuacgaggugaacagcaagugcuacgaggaggccaagaagcugaagaagaucuccaaccaggccgaguucaucgccagcuucuacaacaacgaccugaucaagaucaacggggagcucuaccgggucaucggcgugaacaacgaccugcugaaccgcaucgaggugaacaugaucgacaucacguaccgggaguaccucgagaacaugaacgacaagcgcccgccccggaucaucaagaccaucgcguccaagacccagagcaucaagaaguacuccaccgacauccuggggaaccuguacgaggucaagagcaagaagcacccccagaucaucaagaagggcaagcgccccgccgccacgaagaaggccggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2525 - RNA, 4556 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcuguucaacaagugcaucaucaucagcaucaaccucgacuucuccaacaaggagaagugcaugaccaagcccuacagcaucggccuggacaucgggaccaacuccgugggcugggccgugaucacggacaacuacaagguccccagcaagaagaugaaggugcuggggaacaccuccaagaaguacaucaagaagaaccuccugggcgugcugcuguucgacagcggcaucaccgccgaggggcggcgccugaagcggaccgcccgccggcgcuacacgcggcgccggaaccgcauccuguaccuccaggagaucuucuccaccgagauggccacccuggacgacgcguucuuccagcggcuggacgacagcuuccucguccccgacgacaagcgcgacuccaaguacccgaucuucggcaaccugguggaggagaagguguaccacgacgaguuccccaccaucuaccaccuccggaaguaccucgccgacagcacgaagaaggccgaccugcgccuggucuaccucgcccuggcgcacaugaucaaguaccgggggcacuuccugaucgagggcgaguucaacuccaagaacaacgacauccagaagaacuuccaggacuuccucgacaccuacaacgccaucuucgagagcgaccugucccuggagaacagcaagcagcucgaggagaucgugaaggacaagaucuccaagcuggagaagaaggaccgcauccugaagcuguuccccggggagaagaacagcggcaucuucuccgaguuccugaagcugaucgugggcaaccaggccgacuuccggaagugcuucaaccucgacgagaaggccagccugcacuucuccaaggagagcuacgacgaggaccuggagacccuccugggguacaucggcgacgacuacagcgacgucuuccugaaggccaagaagcucuacgacgcgauccugcuguccggguuccucaccgugacggacaacgagaccgaggcgccccugagcuccgccaugaucaagcgcuacaacgagcacaaggaggaccuggcccuccugaaggaguacauccggaacaucagccugaagaccuacaacgagguguucaaggacgacaccaagaacggcuacgccggcuacaucgacgggaagacgaaccaggaggacuucuacgucuaccucaagaaccugcuggccgaguucgagggcgccgacuacuuccucgagaagaucgaccgcgaggacuuccugcggaagcagcgcaccuucgacaacggguccaucccguaccagauccaccuccaggagaugcgcgccauccuggacaagcaggccaaguucuaccccuuccucgccaagaacaaggagcggaucgagaagauccugaccuuccgcauccccuacuacgugggcccccuggcgcgggggaacagcgacuucgccugguccauccgcaagcggaacgagaagaucaccccguggaacuucgaggacgugaucgacaaggagagcuccgccgaggccuucaucaaccgcaugacgagcuucgaccucuaccugcccgaggagaagguccugcccaagcacucccuccuguacgagaccuucaacguguacaacgagcugaccaaggugcgguucaucgccgagagcaugcgcgacuaccaguuccucgacuccaagcagaagaaggacaucguccggcuguacuucaaggacaagcgcaaggugaccgacaaggacaucaucgaguaccugcacgcgaucuacggcuacgacggcaucgagcucaaggggaucgagaagcaguucaacagcucccugagcacguaccacgaccugcucaacaucaucaacgacaaggaguuccuggacgacuccagcaacgaggccaucaucgaggagaucauccacacccugaccaucuucgaggaccgggagaugaucaagcagcgccucuccaaguucgagaacaucuucgacaagagcgugcugaagaagcugagccggcgccacuacaccggcugggggaagcucuccgccaagcugaucaacggcauccgggacgagaaguccgggaacacgauccuggacuaccucaucgacgacggcaucagcaaccgcaacuucaugcagcugauccacgacgacgcccugagcuucaagaagaagauccagaaggcgcagaucaucggcgacgaggacaaggggaacaucaaggaggucgugaagucccuccccggcagcccggccaucaagaaggggauccugcaguccaucaagaucgucgacgagcuggugaaggugaugggcgggcggaagcccgagagcaucgucguggagauggcccgcgagaaccaguacaccaaccagggcaaguccaacagccagcagcggcucaagcgccuggagaagucccugaaggagcucggcagcaagauccugaaggagaacauccccgccaagcuguccaagaucgacaacaacgcccuccagaacgaccgccuguaccuguacuaccuccagaacgggaaggacauguacaccggcgacgaccuggacaucgaccggcugagcaacuacgacaucgaccacaucaucccccaggcguuccucaaggacaacuccaucgacaacaaggugcuggucagcuccgccagcaaccgcgggaaguccgacgacuucccgagccuggagguggugaagaagcggaagaccuucugguaccagcuccucaagagcaagcugaucucccagcgcaaguucgacaaccugacgaaggccgagcggggcggccugcugcccgaggacaaggccggguucauccagcgccagcucgucgagacccggcagaucaccaagcacguggcccgccugcuggacgagaaguucaacaacaagaaggacgagaacaaccgggcggugcgcaccgucaagaucaucacgcucaagagcacccuggugucccaguuccggaaggacuucgagcuguacaaggugcgcgagaucaacgacuuccaccacgcccacgacgccuaccucaacgccgucaucgccagcgcgcugcugaagaaguaccccaagcucgagcccgaguucguguacggcgacuacccgaaguacaacuccuuccgggagcgcaagagcgccaccgagaagguguacuucuacuccaacaucaugaacaucuucaagaaguccaucagccuggccgacgggcgggucaucgagcgcccccugaucgaggugaacgaggagaccggcgagagcguguggaacaaggaguccgaccucgccaccguccggcgcgugcugagcuacccccaggugaacgucgugaagaagguggaggagcagaaccacgggcuggaccggggcaagcccaagggccucuucaacgcgaaccuguccagcaagccgaagcccaacuccaacgagaaccuggucggggccaaggaguaccucgaccccaagaaguacggcggguacgccggcaucagcaacuccuucgccgugcuggugaaggggacgaucgagaagggcgccaagaagaagaucaccaacguccuggaguuccagggcaucagcauccucgaccgcaucaacuaccggaaggacaagcugaacuuccugcucgagaagggguacaaggacaucgagcugaucaucgagcugccgaaguacagccucuucgagcuguccgacggcagccgccgcaugcuggcguccauccucagcaccaacaacaagcgcggggagauccacaagggcaaccagaucuuccugucccagaaguucgugaagcugcucuaccacgccaagcggaucagcaacaccaucaacgagaaccaccggaaguacguggagaaccacaagaaggaguucgaggagcuguucuacuacauccuggaguucaacgagaacuacgucggggccaagaagaacggcaagcuccugaacuccgccuuccagagcuggcagaaccacuccaucgacgagcugugcagcuccuucaucggccccacggggagcgagcgcaagggccucuucgagcugaccucccgggggagcgccgcggacuucgaguuccugggcgugaagaucccccgcuaccgggacuacacccccuccagccuccugaaggacgccacccugauccaccaguccgugacggggcuguacgagacccgcaucgaccucgccaagcugggcgagggcaagcggccggccgccaccaagaaggcggggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2526 - RNA, 3632 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgugguacgccagccugauguccgcccaccaccuccgggugggcaucgacguggggacccacagcgucggccuggccacccugcgcguggacgaccacgggacgcccaucgagcuccuguccgcccugagccacauccacgacuccggcgugggcaaggaggggaagaaggaccacgacacccggaagaagcucagcggcaucgcgcgccgggcccgccggcugcugcaccaccgccggacccagcuccagcagcuggacgagguccugcgcgaccucggguuccccauccccaccccgggcgaguuccuggaccugaacgagcagacggaccccuaccggguguggcgcgugcgggcccgccucgucgaggagaagcugcccgaggagcugcgggggcccgccaucuccauggcggugcgccacaucgcccggcaccgcggcuggcggaacccguacagcaagguggagucccuccugagccccgccgaggagucccccuucaugaaggcccugcgcgagcggauccucgccaccaccggcgagguccuggacgacgggaucacccccggccaggcgauggcccagguggcccugacgcacaacaucagcaugcgcgggccggagggcauccucggcaagcugcaccaguccgacaacgccaacgagauccgcaagaucugcgcccggcagggggugagccccgacgucugcaagcagcugcuccgcgcgguguucaaggccgacagcccccggggcuccgccgugucccgcgucgcccccgacccgcugcccgggcagggcagcuuccggcgcgcccccaagugcgaccccgaguuccagcgguuccgcaucaucuccaucguggcgaaccugcggaucagcgagaccaagggggagaaccgcccgcucaccgccgacgagcggcgccacguggucaccuuccugacggaggacagccaggccgaccugaccuggguggacguggccgagaagcucggcguccaccggcgcgaccugcggggcaccgccgugcacaccgacgacggggagcgcuccgcggcccggccgcccaucgacgccacggaccgcaucaugcggcagaccaagaucagcucccugaagaccuggugggaggaggccgacagcgagcagcgcggcgcgaugauccgcuaccucuacgaggaccccaccgacuccgagugcgccgagaucaucgccgagcugcccgaggaggaccaggccaagcuggacagccuccaccuccccgccgggcgggcggccuacucccgcgagagccugacggcccuguccgaccacaugcuggccaccaccgacgaccugcacgaggcccggaagcgccucuucggcgucgacgacagcugggcgccgcccgccgaggccaucaacgcccccguggggaaccccuccguggaccggacccugaagaucgucggccgcuaccugagcgccguggaguccauguggggcacgcccgaggugauccacgucgagcacgugcgggacggguucaccagcgagcgcauggcggacgagcgggacaaggccaaccgccggcgcuacaacgacaaccaggaggccaugaagaagauccagcgggacuacggcaaggagggguacaucucccgcggcgacaucgugcggcucgacgcccuggagcugcaggggugcgcgugccuguacugcggcaccaccaucggcuaccacacgugccagcucgaccacaucgucccgcaggccgggcccggcagcaacaaccgccgggggaaccugguggccgugugcgagcgcugcaaccgguccaagagcaacacccccuucgccgucugggcccagaagugcggcaucccccacgugggcgugaaggaggcgaucgggcgcguccggggcuggcgcaagcagaccccgaacaccuccagcgaggaccugacgcgccucaagaaggaggugaucgcccggcugcgccggacccaggaggaccccgagaucgacgagcgcagcauggaguccguggccuggauggccaacgagcugcaccaccggaucgccgcggccuaccccgagaccaccgucaugguguaccgcgggagcaucacggccgccgcccggaaggcggccggcaucgacucccgcaucaaccucaucggggagaagggccggaaggaccgcaucgaccggcgccaccacgccguggacgccagcgucguggcgcugauggaggccuccguggccaagacccuggccgagcggagcucccuccgcggcgagcagcggcugaccgggaaggagcagaccuggaagcaguacaccggcagcacggucggggcccgcgagcacuucgagauguggcggggccacaugcugcaccucaccgagcuguucaacgagcgccuggcggaggacaagguguacgugacccagaacauccggcuccgccuguccgacgggaacgcccacaccgucaaccccagcaagcuggugucccaccgccucggcgacggccugacggugcagcagaucgaccgggccugcaccccggcccuguggugcgcccucacccgcgagaaggacuucgacgagaagaacgggcugcccgcgcgggaggaccgcgccauccggguccacggccacgagaucaagagcuccgacuacauccagguguucagcaagcgcaagaagaccgacuccgaccgggacgagacgcccuucggggccaucgccgugcgcggcggguucgucgagaucggccccagcauccaccacgcccggaucuaccgcguggagggcaagaagccgguguacgcgaugcugcgggucuucacccacgaccuccugucccagcgccacggggaccuguucagcgccgugaucccgccccagagcaucuccaugcggugcgccgagcccaagcuccgcaaggccaucaccaccggcaacgccacguaccugggguggguggucgugggcgacgagcuggagaucaacguggacagcuucaccaaguacgcgaucgggcgguuccucgaggacuuccccaacaccacccgcuggcggaucugcggcuacgacacgaacuccaagcugacccugaagcccaucguccucgccgccgagggccuggagaaccccagcuccgccgugaacgagaucguggagcugaagggguggcgcgucgcgaucaacgugcucaccaaggugcaccccaccgucgugcggcgcgacgcccugggccggccgcgcuacagcucccgcagcaaccugcccacguccuggaccaucgagaagcggcccgccgccaccaagaaggccgggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2527 - RNA, 4493 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaccaagcccuacagcaucggccuggacaucgggaccaacuccgugggcugggccgugacgaccgacaacuacaagguccccagcaagaagaugaaggugcucgggaacaccuccaagaaguacaucaagaagaaccugcugggcgugcuccuguucgacagcggcaucaccgccgaggggcggcgccugaagcggacggcccgccggcgcuacacccggcgccggaaccgcauccucuaccugcaggagaucuucuccaccgagauggccacccuggacgacgcguucuuccagcggcucgacgacagcuuccugguccccgacgacaagcgcgacuccaaguacccgaucuucggcaaccugguggaggagaaggccuaccacgacgaguuccccacgaucuaccaccuccggaaguaccuggccgacagcaccaagaaggccgaccugcgccucguguaccuggcgcuggcccacaugaucaaguaccgggggcacuuccucaucgagggcgaguucaacuccaagaacaacgacauccagaagaacuuccaggacuuccuggacaccuacaacgccaucuucgagagcgaccugucccucgagaacagcaagcagcuggaggagaucgucaaggacaagaucuccaagcuggagaagaaggaccgcauccucaagcuguuccccggggagaagaacagcggcaucuucuccgaguuccugaagcucaucgugggcaaccaggccgacuuccggaagugcuucaaccuggacgagaaggccagccugcacuucuccaaggagagcuacgacgaggaccucgagacccugcugggguacaucggcgacgacuacuccgacguguuccucaaggcgaagaagcuguacgacgccauccugcucagcggguuccugacggucaccgacaacgagaccgaggcgccccugagcuccgccaugaucaagcgcuacaacgagcacaaggaggaccucgcccugcugaaggaguacauccggaacaucagccucaagaccuacaacgagguguucaaggacgacacgaagaacggcuacgccggcuacaucgacgggaagaccaaccaggaggacuucuacguguaccugaagaagcugcucgccgaguucgagggcgccgacuacuuccuggagaagaucgaccgcgaggacuuccugcggaagcagcgcaccuucgacaacggguccaucccguaccagauccaccuccaggagaugcgcgccauccuggacaagcaggccaaguucuaccccuuccuggcgaagaacaaggagcggaucgagaagauccugaccuuccgcauccccuacuacgucggcccccucgcccgggggaacagcgacuucgccugguccauccgcaagcggaacgagaagaucacgccguggaacuucgaggacgugaucgacaaggagagcuccgccgaggccuucaucaaccgcaugaccagcuucgaccuguaccugcccgaggagaaggugcuccccaagcacucccugcuguacgagaccuucaacgucuacaacgagcucaccaaggugcgguucaucgcggagagcaugcgcgacuaccaguuccuggacuccaagcagaagaaggacaucgugcggcuguacuucaaggacaagcgcaaggucacggacaaggacaucaucgaguaccuccacgccaucuacggcuacgacggcaucgagcugaaggggaucgagaagcaguucaacagcucccugagcaccuaccacgaccuccugaacaucaucaacgacaaggaguuccuggacgacuccagcaacgaggccaucaucgaggagaucauccacacccucaccaucuucgaggaccgggagaugaucaagcagcgccuguccaaguucgagaacaucuucgacaagagcgugcugaagaagcucucccggcgccacuacacgggcugggggaagcugagcgccaagcugaucaacggcauccgggacgagaaguccgggaacaccauccucgacuaccugaucgacgacggcaucagcaaccgcaacuucaugcagcugauccacgacgacgcgcucagcuucaagaagaagauccagaaggcccagaucaucggcgacgaggacaaggggaacaucaaggagguggucaagucccugcccggcagcccggccaucaagaaggggauccugcaguccaucaagaucguggacgagcucgucaaggugaugggcgggcggaagcccgagagcaucguggucgagauggcccgcgagaaccaguacaccaaccagggcaaguccaacagccagcagcggcugaagcgccuggagaagucccucaaggagcugggcagcaagauccugaaggagaacauccccgccaagcucuccaagaucgacaacaacgcgcugcagaacgaccgccuguaccucuacuaccugcagaacgggaaggacauguacaccggcgacgaccuggacaucgaccggcucagcaacuacgacaucgaccacaucaucccccaggccuuccugaaggacaacuccaucgacaacaaggugcuggugagcuccgccagcaaccgcgggaaguccgacgacgucccgagccucgagguggugaagaagcggaagacguucugguaccagcugcucaagagcaagcugaucucccagcgcaaguucgacaaccugaccaaggccgagcggggcggccugagccccgaggacaaggccggguucauccagcgccagcucgucgagacccggcagaucaccaagcacguggcgcgccugcuggacgagaaguucaacaacaagaaggacgagaacaaccgggccgugcgcacggucaagaucaucacccucaaguccacccuggugagccaguuccggaaggacuucgagcuguacaaggugcgcgagaucaacgacuuccaccacgcccacgacgccuaccucaacgccgucguggcguccgcccugcugaagaaguaccccaagcucgagcccgaguucguguacggcgacuacccgaaguacaacagcuuccgggagcgcaaguccgccaccgagaaggucuacuucuacagcaacaucaugaacaucuucaagaaguccaucagccuggccgacgggcgggugaucgagcgcccccugaucgaggugaacgaggagaccggcgaguccgucuggaacaaggagagcgaccucgcgacggugcggcgcgugcuguccuacccccaggucaacguggugaagaaggucgaggagcagaaccacgggcuggaccggggcaagcccaagggccucuucaacgccaaccugagcuccaagccgaagcccaacagcaacgagaaccuggugggggccaaggaguaccucgaccccaagaaguacggcggguacgccggcaucuccaacagcuucaccgugcuggucaaggggaccaucgagaagggcgccaagaagaagaucaccaacgugcuggaguuccagggcaucuccauccucgaccgcaucaacuaccggaaggacaagcugaacuuccugcucgagaagggguacaaggacaucgagcugaucaucgagcugccgaaguacagccucuucgagcugagcgacggcucccgccgcaugcuggcgagcauccucuccacgaacaacaagcgcggggagauccacaagggcaaccagaucuuccugagccagaaguucgugaagcugcucuaccacgccaagcggaucuccaacaccaucaacgagaaccaccggaaguacgucgagaaccacaagaaggaguucgaggagcuguucuacuacauccuggaguucaacgagaacuacgugggggccaagaagaacggcaagcuccugaacagcgccuuccaguccuggcagaaccacagcaucgacgagcugugcuccagcuucaucggccccaccggguccgagcgcaagggccucuucgagcugaccagccggggguccgccgcggacuucgaguuccugggcgugaagaucccccgcuaccgggacuacacgcccagcucccuccugaaggacgccacccugauccaccagagcgucaccgggcucuacgagacccgcaucgaccuggccaagcugggcgagggcaagcggccggccgccacgaagaaggcggggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2528 - RNA, 3575 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccuucaagcccaacagcaucaacuacauccugggccucgacaucgggaucgccuccgugggcugggccaugguggagaucgacgaggaggagaaccccauccggcugaucgaccuggggguccgcguguucgagcgggcggaggugcccaagaccggcgacagccucgccauggcccgccggcuggcccgcuccguccggcgccugacccggcgccgggcgcaccgccuccugcggacgcgccggcugcucaagcgcgagggcgugcugcaggccgccaacuucgacgagaacgggcugaucaagagccucccgaacacccccuggcagcugcgggccgccgcgcuggaccgcaagcucacgccccuggagugguccgccgugcugcuccaccugaucaagcaccggggcuaccugagccagcgcaagaacgagggggagaccgccgacaaggagcucggcgcccugcugaagggggucgccggcaacgcgcacgcccuccagaccggcgacuuccggacccccgccgagcuggcccugaacaaguucgagaaggaguccgggcacauccgcaaccagcgcagcgacuacucccacaccuucagccggaaggaccuccaggccgagcugauccuccuguucgagaagcagaaggaguucggcaacccgcacguguccgggggccugaaggagggcaucgagacccugcucaugacgcagcgccccgcgcugagcggggacgccgugcagaagaugcugggccacugcaccuucgagcccgccgagcccaaggccgccaagaacaccuacaccgcggagcgguucaucuggcucacgaagcugaacaaccugcgcauccucgagcagggguccgagcggccgcugaccgacaccgagcgcgccacccugauggacgagcccuaccgcaagagcaagcucacguacgcccaggcccggaagcugcugggccucgaggacaccgcguucuucaaggggcugcgguacggcaaggacaacgccgaggccuccacccugauggagaugaaggccuaccacgccaucagccgcgcgcucgagaaggagggccugaaggacaagaaguccccgcugaaccugagccccgagcuccaggacgagaucgggaccgccuucucccuguucaagacggacgaggacaucaccggccggcugaaggaccgcauccagccggagauccucgaggcccugcugaagcacaucagcuucgacaaguucguccagaucagccucaaggcccugcggcgcaucgugccccugauggagcaggggaagcgguacgacgaggccugcgcggagaucuacggcgaccacuacgggaagaagaacaccgaggagaagaucuaccucccgcccauccccgccgacgagauccgcaaccccgugguccugcgggcccugucccaggcccgcaaggugaucaacggcgugguccggcgcuacggcagccccgcccgcauccacaucgagaccgcgcgggagguggggaaguccuucaaggaccgcaaggagaucgagaagcggcaggaggagaaccgcaaggaccgggagaaggccgccgccaaguuccgcgaguacuuccccaacuucgugggcgagcccaagagcaaggacauccucaagcugcggcuguacgagcagcagcacgggaagugccucuacuccggcaaggagaucaaccuggggcgccugaacgagaagggcuacgucgagaucgaccacgcgcuccccuucagccggacgugggacgacuccuucaacaacaaggugcuggugcugggcagcgagaaccagaacaaggggaaccagacccccuacgaguacuucaacggcaaggacaacucccgcgaguggcaggaguucaaggcccgggucgagaccagccgcuucccccgguccaagaagcagcgcauccuccugcagaaguucgacgaggacggguucaaggagcggaaccugaacgacacccgcuacgugaaccgguuccucugccaguucgucgccgaccgcaugcggcugacgggcaagggcaagaagcgcguguucgccagcaacgggcagaucaccaaccugcuccggggcuucugggggcugcgcaaggugcgcgccgagaacgaccggcaccacgcgcuggacgccgucgugguggccugcuccaccgucgccaugcagcagaagaucacccgcuucgugcgguacaaggagaugaacgccuucgacggcaagacgaucgacaaggagaccggggaggugcuccaccagaagacccacuucccgcagcccugggaguucuucgcgcaggaggucaugauccgcguguucggcaagcccgacggcaagccggaguucgaggaggccgacacccuggagaagcugcggacgcuccuggccgagaagcugagcucccgccccgaggccgugcacgaguacgucacgccccucuucgugagccgggcccccaaccgcaagauguccgggcagggccacauggagaccgucaagagcgcgaagcggcuggacgaggggguguccgugcugcgcgugccgcucacccagcugaagcugaaggaccucgagaagauggucaaccgggagcgcgagcccaagcuguacgaggcccugaaggcccggcucgaggcccacaaggacgaccccgcgaaggccuucgccgagcccuucuacaaguacgacaaggccggcaaccgcacccagcaggucaaggccgugcggguggagcagguccagaagaccggggugugggugcgcaaccacaacggcaucgcggacaacgccaccauggugcggguggacgucuucgagaagggcgacaaguacuaccuggugccgaucuacagcuggcaggucgccaaggggauccugcccgaccgcgccguggugcagggcaaggacgaggaggacuggcagcucaucgacgacagcuucaacuucaaguucucccugcaccccaacgaccugguggaggucaucaccaagaaggcccggauguucggguacuucgcgagcugccaccgcggcaccgggaacaucaacauccgcauccacgaccucgaccacaagaucggcaagaacggcauccuggaggggaucggcgugaagacggcccuguccuuccagaaguaccagaucgacgagcucgggaaggagauccggcccugccgccugaagaagcggccgcccgugcgcaagcggcccgccgccaccaagaaggccggccaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2529 - RNA, 4331 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagcccuacaccaucggccuggacaucgggaccaacagcgugggcugggccgugcucacggaccaguacgaccuggucaagcggaagaugaagaucgccggggacuccgagaagaagcagaucaagaagaacuucuggggcgugcgccuguucgacgagggccagaccgccgccgaccggcgcauggcgcggaccgcccgccggcgcaucgagcggcgccggaaccgcaucagcuaccuccaggggaucuucgccgaggagauguccaagaccgacgccaacuucuucugccggcugagcgacuccuucuacguggacaacgagaagcgcaacagccggcaccccuucuucgcgacgaucgaggaggaggucgaguaccacaagaacuaccccaccaucuaccaccuccgcgaggagcuggugaacuccagcgagaaggccgaccugcggcugguguaccucgcccuggcccacaucaucaaguaccgcggcaacuuccugaucgagggggcccucgacacccagaacaccuccgucgacggcaucuacaagcaguucauccagacguacaaccagguguucgcgagcgggaucgaggacggcucccugaagaagcuggaggacaacaaggacguggccaagauccucgucgagaaggugacccggaaggagaagcuggagcgcauccugaagcucuacccgggcgagaaguccgccgggauguucgcccaguucaucagccugaucgugggcagcaaggggaacuuccagaagcccuucgaccugaucgagaaguccgacaucgagugcgccaaggacagcuacgaggaggaccucgagucccugcuggcgcucaucggcgacgaguacgccgagcuguucgucgccgccaagaacgccuacagcgcgguggugcuguccagcaucaucaccgucgccgagaccgagacgaacgccaagcucagcgccuccaugaucgagcgguucgacacccacgaggaggaccugggcgagcugaaggccuucaucaagcuccaccuccccaagcacuacgaggagaucuucagcaacaccgagaagcacggguacgcgggcuacaucgacgggaagaccaagcaggccgacuucuacaaguacaugaagaugacgcuggagaacaucgagggcgccgacuacuucaucgccaagaucgagaaggagaacuuccugcgcaagcagcgcaccuucgacaacggggcgaucccccaccagcugcaccuggaggagcucgaggccauccugcaccagcaggccaaguacuacccguuccugaaggagaacuacgacaagaucaagucccucgugaccuuccggauccccuacuucgugggcccccuggccaacggccagagcgaguucgccuggcugacccgcaaggcggacggggagauccggcccuggaacaucgaggagaaggucgacuucggcaaguccgccguggacuucaucgagaagaugacgaacaaggacaccuaccucccgaaggagaacgugcugcccaagcacagccugugcuaccagaaguaccucgucuacaacgagcugaccaaggugcgcuacaucaacgaccaggggaagaccuccuacuucagcggccaggagaaggagcagaucuucaacgaccuguucaagcagaagcggaaggucaagaagaaggaccucgagcuguuccugcgcaacaugucccacguggagagccccacgaucgaggggcuggaggacuccuucaacagcuccuacagcaccuaccacgaccuccugaaggugggcaucaagcaggagauccuggacaaccccgucaacaccgagaugcucgagaacaucgugaagauccugaccguguucgaggacaagcggaugaucaaggagcagcugcagcaguucuccgacguccucgacggcguggugcugaagaagcuggagcgccggcacuacacgggguggggccgccucagcgccaagcugcugauggggauccgggacaagcagucccaccucaccauccuggacuaccugaugaacgacgacggccucaaccgcaaccugaugcagcugaucaacgacagcaaccucuccuucaagagcaucaucgagaaggagcaggucaccaccgccgacaaggacauccagagcaucguggccgaccuggcgggguccccggccaucaagaagggcauccugcagagccucaagaucguggacgagcuggucuccgugaugggcuacccgccccagacgaucguggucgagauggcccgggagaaccagaccaccgggaagggcaagaacaacagccgcccccgguacaagucccuggagaaggccaucaaggaguucgggagccagauccucaaggagcaccccaccgacaaccaggagcugcgcaacaaccggcuguaccucuacuaccugcagaacggcaaggacauguacacgggccaggaccuggacauccacaaccucuccaacuacgacaucgaccacaucgugccccagagcuucaucaccgacaacuccaucgacaaccuggugcugaccagcuccgccgggaaccgcgagaagggcgacgacgucccgccccucgagaucgugcggaagcgcaagguguucugggagaagcuguaccaggggaaccugaugagcaagcgcaaguucgacuaccucaccaaggcggagcggggcgggcugaccgaggccgacaaggcccgcuucauccaccggcagcuggucgagacgcgccagaucaccaagaacguggccaacauccuccaccagcgguucaacuacgagaaggacgaccacggcaacaccaugaagcagguccgcaucgugacccugaaguccgcgcuggugagccaguuccggaagcaguuccagcucuacaaggugcgcgacgucaacgacuaccaccacgcccacgacgccuaccugaacggcgugguggccaacacgcugcucaaggucuacccccagcuggagcccgaguucguguacggggacuaccaccaguucgacugguucaaggccaacaaggcgaccgccaagaagcaguucuacaccaacaucaugcuguucuucgcccagaaggaccggaucaucgacgagaacggcgagauccucugggacaagaaguaccuggacaccgugaagaaggucauguccuaccgccagaugaacaucgugaagaagacggagauccagaagggggaguucagcaaggccaccaucaagcccaagggcaacuccagcaagcugaucccccggaagaccaacugggacccgaugaaguacgggggccucgacagccccaacauggccuacgcgguggucaucgaguacgccaagggcaagaacaagcugguguucgagaagaagaucauccgcgugaccaucauggagcggaaggccuucgagaaggacgagaaggccuuccuggaggagcagggguaccgccagcccaagguccucgccaagcugccgaaguacacgcuguacgagugcgaggagggccggcgccggaugcucgcguccgccaacgaggcccagaaggggaaccagcagguccugcccaaccaccuggugacccuccugcaccacgccgcgaacugcgaggugagcgacggcaagucccuggacuacaucgagagcaaccgcgagauguucgccgagcuccuggcccacguguccgaguucgccaagcgguacacccuggccgaggcgaaccucaacaagaucaaccagcuguucgagcagaacaaggagggggacaucaaggccaucgcccagagcuucguggaccugauggccuucaacgccaugggcgcgcccgccuccuucaaguucuucgagaccacgaucgagcgcaagcgguacaacaaccucaaggagcugcugaacagcaccaucaucuaccaguccaucaccggccucuacgagagccgcaagcgccuggacgacaagcggcccgccgccaccaagaaggccgggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2530 - RNA, 4364 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaagaagcccuacagcaucggccuggacaucgggaccaacuccgugggcugggccguggucaccgacgacuacaaggugcccgccaagaagaugaaggugcucgggaacacggacaagagccacaucgagaagaaccugcugggcgcccuccuguucgacuccggcaacaccgccgaggaccggcgccugaagcggaccgcgcgccggcgcuacacccggcgccggaaccgcauccucuaccugcaggagaucuucagcgaggagauggggaaggucgacgacuccuucuuccaccggcuggaggacagcuuccucgugacggaggacaagcgcggcgagcggcaccccaucuucgggaaccuggaggaggaggugaaguaccacgagaacuucccgaccaucuaccaccuccgccaguaccuggccgacaaccccgagaaggucgaccugcggcugguguaccucgcccuggcccacaucaucaaguuccgcggccacuuccugaucgaggggaaguucgacacccggaacaacgacgugcagcgccucuuccaggaguuccuggcggucuacgacaacaccuucgagaacuccagccugcaggagcagaacguccagguggaggagauccucacggacaagaucuccaagagcgccaagaaggaccgggugcugaagcuguuccccaacgagaaguccaacggccgcuucgccgaguuccucaagcugaucgugggcaaccaggccgacuucaagaagcacuucgagcuggaggagaaggccccgcuccaguucagcaaggacaccuacgaggaggagcuggaggugcugcucgcgcagaucggggacaacuacgccgagcuguuccuguccgccaagaagcucuacgacagcauccugcuguccggcauccucaccgucaccgacguggggacgaaggccccgcugagcgccuccaugauccagcgguacaacgagcaccagauggaccuggcgcagcucaagcaguucauccgccagaagcugagcgacaaguacaacgagguguucuccgacgucagcaaggacggcuacgccggcuacaucgacgggaagaccaaccaggaggccuucuacaaguaccugaagggccuccugaacaagaucgaggggagcggcuacuuccuggacaagaucgagcgcgaggacuuccuccggaagcagcgcaccuucgacaacggguccaucccccaccagauccaccuccaggagaugcgggccaucauccgccggcaggccgaguucuaccccuuccuggcggacaaccaggaccgcaucgagaagcugcugaccuuccggauccccuacuacgugggcccgcuggcccgcggcaagagcgacuucgccuggcugucccgcaagagcgccgacaagaucacgcccuggaacuucgacgagaucguggacaaggaguccagcgccgaggcguucaucaaccggaugaccaacuacgaccucuaccugcccaaccagaagguccugcccaagcacucccuccuguacgagaaguucaccguguacaacgagcugaccaaggucaaguacaagacggagcaggggaagaccgccuucuucgacgccaacaugaagcaggagaucuucgacggcguguucaagguguaccggaaggucaccaaggacaagcucauggacuuccuggagaaggaguucgacgaguuccgcaucguggaccugaccgggcucgacaaggagaacaagguguucaacgccagcuacggcacguaccacgaccugugcaagauccuggacaaggacuuccucgacaacuccaagaacgagaagauccuggaggacaucguccugacccucacccuguucgaggaccgggagaugauccgcaagcggcuggagaacuacagcgaccuccugaccaaggagcaggucaagaagcuggagcgccggcacuacacgggguggggccgccucuccgcggagcugauccacggcauccggaacaaggagagccgcaagaccauccuggacuaccucaucgacgacgggaacuccaaccgcaacuucaugcagcugaucaacgacgacgcccugagcuucaaggaggagaucgccaaggcccaggugaucggcgagaccgacaaccucaaccaggugguguccgacaucgccgggagcccggcgaucaagaagggcauccugcagucccugaagaucguggacgagcucgucaagaucauggggcaccagcccgagaacaucgugguggagauggcccgggagaaccaguucaccaaccagggccgccggaacagccagcagcgccugaagggccugacggacuccaucaaggaguucgggagccagauccucaaggagcaccccgucgagaacagccagcugcagaacgaccggcuguuccucuacuaccugcagaacggccgcgacauguacaccggggaggagcuggacaucgacuaccucucccaguacgacaucgaccacaucaucccccaggccuucaucaaggacaacagcaucgacaaccgggugcugaccuccagcaaggagaaccgcggcaaguccgacgacgugccgagcaaggacgucgugcggaagaugaaguccuacuggagcaagcugcucuccgccaagcugaucacccagcgcaaguucgacaaccugacgaaggccgagcggggcgggcucaccgacgacgacaaggcgggcuucaucaagcgccagcugguggagacccggcagaucaccaagcacgucgcccgcauccuggacgagcgguucaacaccgagacggacgagaacaacaagaagauccgccaggugaagaucgugacccucaagagcaaccuggucuccaacuuccggaaggaguucgagcuguacaaggugcgcgagaucaacgacuaccaccacgcccacgacgccuaccucaacgccgugaucgggaaggcgcugcugggcgucuacccccagcucgagcccgaguucguguacggggacuacccccacuuccacggccacaaggagaacaaggccaccgccaagaaguucuucuacagcaacaucaugaacuucuucaagaaggacgacgugcggaccgacaagaacggcgagaucaucuggaagaaggacgagcacaucuccaacaucaagaagguccugagcuacccccaggugaacaucgugaagaaggucgaggagcagaccgggggcuucuccaaggagagcauccugcccaaggggaacuccgacaagcucaucccccgcaagacgaagaaguucuacugggacaccaagaaguacggcggguucgacagccccaucguggccuacagcauccuggugaucgcggacaucgagaagggcaaguccaagaagcugaagaccgucaaggcccucgugggcgugacgaucauggagaagaugaccuucgagcgggacccggucgccuuccuggagcgcaagggguaccgcaacgugcaggaggagaacaucaucaagcugcccaaguacagccucuucaagcuggagaacggccggaagcgccugcucgccuccgcccgggagcugcagaaggggaacgagaucgugcugcccaaccaccucggcacccugcuguaccacgcgaagaacauccacaaggucgacgagccgaagcaccucgacuacguggacaagcacaaggacgaguucaaggagcugcuggacguggucagcaacuucuccaagaaguacacccucgccgaggggaaccuggagaagaucaaggagcuguacgcccagaacaacggcgaggaccucaaggagcuggccagcuccuucaucaaccugcucacguucaccgccaucggcgcgcccgccaccuucaaguucuucgacaagaacaucgaccgcaagcgguacaccagcacgaccgagauccugaacgccacccugauccaccaguccaucaccgggcucuacgagacgcgcaucgaccugaacaagcugggcggggacaagcggcccgccgccaccaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2531 - RNA, 3497 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgcagaccaccaaccugagcuacauccucggccuggaccuggggaucgccuccgugggcugggccguggucgagaucaacgagaacgaggaccccaucgggcucaucgacgugggcgugcggaucuucgagcgcgccgagguccccaagacgggcgagagccuggcccugucccggcgccucgcgcggagcacccgccggcugauccgccggcgcgcccaccggcugcuccuggccaagcgcuuccugaagcgggaggggauccucuccaccaucgaccuggagaagggccugcccaaccaggccugggagcuccgcguggcggggcuggagcggcgccugagcgccaucgaguggggcgccgugcuccugcaccugaucaagcaccggggguaccucuccaagcgcaagaacgagagccagaccaacaacaaggagcugggcgcccugcucuccggcgucgcccagaaccaccagcugcugcagagcgacgacuaccggacgccggcggagcucgcccugaagaaguucgccaaggaggaggggcacauccgcaaccagcggggcgccuacacccacaccuucaaccgccuggaccuccuggccgagcugaaccuccuguucgcgcagcagcaccaguucgggaacccccacugcaaggagcacauccagcaguacaugaccgagcugcucauguggcagaagcccgcccuguccggcgaggccauccugaagaugcucggcaagugcacgcacgagaagaacgaguucaaggccgccaagcacaccuacagcgcggagcgcuucguguggcugaccaagcugaacaaccuccggauccuggaggacggggccgagcgcgcccugaacgaggaggagcggcagcuccugaucaaccaccccuacgagaaguccaagcugaccuacgcccaggugcgcaagcuccugggccugagcgagcaggccaucuucaagcaccuccgguacuccaaggagaacgcggagagcgccacguucauggagcucaaggccuggcacgccauccgcaaggcgcuggagaaccaggggcugaaggacaccuggcaggaccucgccaagaagccggaccugcuggacgagaucggcaccgccuucucccucuacaagaccgacgaggacauccagcaguaccugacgaacaagguccccaacagcgugaucaacgcccugcucgugucccugaacuucgacaaguucaucgagcugagccucaagagccugcggaagauccugccccucauggagcaggggaagcgcuacgaccaggccugccgggagaucuacggccaccacuacggcgaggcgaaccagaagaccucccagcugcugcccgccaucccggcccaggagauccgcaaccccgucgugcuccggacccugagccaggcccgcaaggugaucaacgccaucauccggcaguacgggucccccgcgcgcguccacaucgagaccggccgggagcugggcaagagcuucaaggagcgccgggagauccagaagcagcaggaggacaaccgcacgaagcgggaguccgccgugcagaaguucaaggagcuguucagcgacuucuccagcgagcccaaguccaaggacauccugaaguuccgccuguacgagcagcagcacgggaagugccucuacagcgggaaggagaucaacauccaccgccugaacgagaagggcuacguggagaucgaccacgcccugccguucucccggaccugggacgacagcuucaacaacaagguccucgugcuggccuccgagaaccagaacaagggcaaccagacccccuacgaguggcugcaggggaagaucaacagcgagcgcuggaagaacuucguggcccucguccugggcucccagugcagcgcggccaagaagcagcggcugcucacccaggugaucgacgacaacaaguucaucgaccgcaaccugaacgacacgcgguacaucgcccgcuuccuguccaacuacauccaggagaaccuccugcuggucgggaagaacaagaagaacguguucacccccaacggccagaucaccgcccuccugcggagccgcugggggcugaucaaggcgcgggagaacaacaaccgccaccacgcccucgacgccaucguggucgccugcgccacccccuccaugcagcagaagaucacgcgguucauccgcuucaaggaggugcacccguacaagaucgagaaccgguacgagaugguggaccaggagagcggcgagaucaucagcccccacuuccccgagcccugggcguacuuccgccaggaggucaacauccggguguucgacaaccacccggacaccgugcugaaggagaugcugcccgaccgcccccaggccaaccaccaguucguccagccccucuucgugucccgggccccgacccgcaagaugagcggccaggggcacauggagaccaucaaguccgccaagcggcuggccgagggcaucagcgugcugcgcaucccccucacgcagcugaagcccaaccugcucgagaacauggucaacaaggagcgggagccggcgcuguacgccgggcugaaggcccgccucgccgaguucaaccaggaccccgccaaggcguucgccacccccuucuacaagcagggcggccagcaggucaaggccauccgcguggagcagguccagaaguccggggugcuggugcgggagaacaacggcguggccgacaacgcgagcaucgugcgcaccgacguguucaucaagaacaacaaguucuuccugguccccaucuacaccuggcaggucgccaaggggauccucccgaacaaggccaucguggcccacaagaacgaggacgagugggaggagauggacgagggcgccaaguucaaguucucccuguuccccaacgaccugguggagcucaagacgaagaaggaguacuucuucggguacuacaucggccuggaccgggcgaccggcaacaucagccugaaggagcacgacggggagaucuccaagggcaaggacgggguguaccgcgugggcgucaagcucgcccugagcuucgagaaguaccagguggacgagcuggggaagaaccggcagaucugccgcccccagcagcggcagcccgugcgcaagcggccggccgccaccaagaaggccggccaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2532 - RNA, 3575 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggccgccuucaagcccaaccccaucaacuacauccugggccucgacaucgggaucgccagcgugggcugggccaugguggagaucgacgaggacgagaaccccaucugccugaucgaccuggggguccggguguucgagcgcgcggaggugccgaagaccggcgacucccucgccauggcccggcgccuggcccggagcguccgccggcugacccgccggcgcgcgcaccggcuccugcgcgcccggcgccugcucaagcgggagggcgugcugcaggccgccgacuucgacgagaacgggcugaucaagucccuccccaacacgcccuggcagcugcgcgccgcggcccuggaccggaagcucacgccccuggaguggagcgccgugcugcuccaccugaucaagcaccgcggcuaccugucccagcggaagaacgagggggagaccgccgacaaggagcucggcgcccugcugaagggggucgcggacaacgcccacgcccuccagaccggcgacuuccgcaccccggccgagcuggcccugaacaaguucgagaaggagagcggccacauccggaaccagcgcggggacuacucccacaccuucagccgcaaggaccuccaggcggagcugauccuccucuucgagaagcagaaggaguucggcaacccccacguguccgggggccugaaggagggcaucgagacccugcucaugacccagcggcccgcccugagcggggacgccgugcagaagaugcugggccacugcacguucgagcccgccgagccgaaggccgcgaagaacaccuacaccgccgagcgcuucaucuggcucaccaagcugaacaaccugcggauccucgagcagggguccgagcgcccccugacggacaccgagcgggccacccugauggacgagcccuaccgcaagagcaagcucaccuacgcccaggcgcggaagcugcugggccucgaggacacggccuucuucaaggggcugcgcuacggcaaggacaacgccgaggccuccacccugauggagaugaaggccuaccacgcgaucagccgggcccucgagaaggagggccugaaggacaagaaguccccgcugaaccugagccccgagcuccaggacgagaucgggaccgccuucucccuguucaagaccgacgaggacaucacgggccgccugaaggaccggauccagcccgagauccucgaggcccugcugaagcacaucagcuucgacaaguucguccagaucucccucaaggcccugcgccggaucgugccccugauggagcaggggaagcgcuacgacgaggcgugcgccgagaucuacggcgaccacuacgggaagaagaacaccgaggagaagaucuaccugcccccgauccccgccgacgagauccggaaccccgugguccugcgcgcccugagccaggcccggaaggugaucaacggcgugguccgccgguacggcagccccgcgcgcauccacaucgagaccgcccgcgagguggggaaguccuucaaggaccggaaggagaucgagaagcgccaggaggagaaccggaaggaccgcgagaaggccgccgcgaaguuccgggaguacuucccgaacuucgugggcgagcccaagagcaaggacauccucaagcugcgccuguacgagcagcagcacgggaagugccucuacuccggcaaggagaucaaccuggggcggcugaacgagaagggcuacgucgagaucgaccacgcccuccccuucagccgcaccugggacgacuccuucaacaacaaggugcuggugcugggcagcgagaaccagaacaaggggaaccagacgcccuacgaguacuucaacggcaaggacaacucccgggaguggcaggaguucaaggcccgcgucgagaccagccgguucccgcgcuccaagaagcagcggauccuccugcagaaguucgacgaggacggguucaaggagcgcaaccugaacgacacccgguacgugaaccgcuuccucugccaguucgucgccgaccggaugcgccugaccggcaagggcaagaagcggguguucgccagcaacgggcagaucacgaaccugcuccgcggcuucugggggcugcggaaggugcgcgcggagaacgaccgccaccacgcccuggacgccgucgugguggccugcuccaccgucgccaugcagcagaagaucacccgguucgugcgcuacaaggagaugaacgcguucgacggcaagaccaucgacaaggagacgggggaggugcuccaccagaagacccacuucccccagcccugggaguucuucgcccaggaggucaugauccggguguucggcaagccggacggcaagcccgaguucgaggaggccgacacccccgagaagcugcgcacccugcucgccgagaagcugagcucccggcccgaggccgugcacgaguacgucacgccgcuguucgugagccgcgcgcccaaccggaagauguccgggcagggccacauggagaccgucaagagcgccaagcgccucgacgaggggguguccgugcugcgggugccccugacccagcucaagcugaaggaccuggagaagauggucaaccgcgagcgggagcccaagcucuacgaggcccugaaggcccgccuggaggcgcacaaggacgacccggccaaggccuucgccgagcccuucuacaaguacgacaaggccggcaaccggacccagcaggucaaggcggugcgcguggagcagguccagaagaccggggugugggugcggaaccacaacggcaucgccgacaacgccacgauggugcgcguggacgucuucgagaagggcgacaaguacuaccucgugcccaucuacagcuggcaggucgccaaggggauccugcccgaccgggccguggugcagggcaaggacgaggaggacuggcagcugaucgacgacuccuucaacuucaaguucagccuccacccgaacgaccugguggaggucaucaccaagaaggcgcgcauguucggguacuucgccagcugccaccggggcaccgggaacaucaacauccgcauccacgaccuggaccacaagaucggcaagaacggcauccucgaggggaucggcgugaagaccgcccuguccuuccagaaguaccagaucgacgagcuggggaaggagauccgccccugccggcucaagaagcgcccgcccgugcggaagcgccccgccgccacgaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2533 - RNA, 3581 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgaaguaccacgugggcaucgacguggggaccuucagcgucggccuggccgccaucgagguggacgacgccgggaugcccaucaagacccugucccuggugagccacauccacgacuccggccuggaccccgacgagaucaagagcgccgucacgcggcucgcguccagcggcaucgcccgccggacccgccggcuguaccgccggaagcgccggcgccugcagcagcucgacaaguucauccagcggcagggguggcccgugaucgagcuggaggacuacuccgacccgcuguaccccuggaaggugcgcgccgagcucgccgcgagcuacaucgccgacgagaaggagcggggcgagaagcuguccgucgcccugcgccacaucgcccggcaccgcggguggcggaaccccuacgccaaggugagcucccucuaccugcccgacggcccgagcgacgcguucaaggccauccgcgaggagaucaagcgggccuccgggcagcccgugcccgagaccgccaccgucggccagauggugacgcugugcgagcucggcacccugaagcugcgcggggagggcggggugcucagcgcccggcugcagcaguccgacuacgcgcgcgagauccaggagaucugccgcaugcaggagaucggccaggagcuguaccggaagaucaucgacgucguguucgccgccgagagccccaagggcuccgccagcucccgcguggggaaggacccgcuccagcccggcaagaaccgggcccugaaggcgagcgacgccuuccagcgcuaccggaucgccgcccugaucgggaaccuccgcguccggguggacggcgagaagcgcauccugagcguggaggagaagaaccuggucuucgaccaccucgugaaccugacccccaagaaggagcccgagugggugaccaucgccgagauccuggggaucgaccggggccagcucaucggcacggcgaccaugaccgacgacggggagcgcgccggcgcccggccgcccacccacgacacgaaccgcuccaucgucaacagccggaucgcgccccugguggacugguggaagaccgccuccgcccuggagcagcacgccauggucaaggcccucagcaacgccgagguggacgacuucgacucccccgagggggcgaaggugcaggccuucuucgccgaccuggacgacgacguccacgccaagcuggacagccuccaccucccggugggccgcgccgcguacuccgaggacacccuggugcggcucacccgccggaugcugagcgacggggucgaccuguacacggcccgccuccaggaguucggcaucgagcccuccuggaccccgcccacgccccggaucggcgagcccguggggaaccccgccguggaccgcguccugaagaccgugagccgcuggcuggaguccgccaccaagaccuggggcgcccccgagcgggugaucaucgagcacguccgcgagggguucgugaccgagaagcgggcgcgcgagauggacggcgacaugcggcgccgggccgcccgcaacgccaagcuguuccaggagaugcaggagaagcugaacgugcaggggaagccgagccgggcggaccuguggcgcuaccaguccguccagcggcagaacugccagugcgccuacugcggcagccccaucaccuucuccaacagcgagauggaccacaucgugccccgcgccggccagggguccacgaacacccgggagaaccucguggccgucugccaccgcugcaaccagagcaagggcaacaccccguucgccaucugggcgaagaacaccuccaucgagggggugagcgugaaggaggccgucgagcggacgcgccacugggugaccgacaccggcaugcggagcaccgacuucaagaaguucacgaaggccguggucgagcgcuuccagcgggccaccauggacgaggagaucgacgcccgcuccauggagagcguggcguggauggccaacgagcugcggucccgcguggcccagcacuucgccagccacggcaccaccguccgcguguaccgggggucccugacggccgaggcgcgccgggccagcggcaucuccgggaagcugaaguucuucgacggcgugggcaagagccgccucgaccggcgccaccacgccaucgacgccgcggucaucgccuucaccuccgacuacguggccgagacccuggccgugcggagcaaccugaagcagucccaggcccaccgccaggaggcgccccaguggcgggaguucaccgggaaggacgccgagcaccgcgccgccuggcgggucuggugccagaagauggagaagcucagcgcccugcugaccgaggaccuccgcgacgaccgggugguggucauguccaacgugcgccugcggcugggcaacgggagcgcgcacaaggagacgaucggcaagcucuccaaggugaagcugagcucccagcugagcgucagcgacaucgacaaggccuccagcgaggcccucuggugcgcccugacccgcgagcccggguucgaccccaaggagggccugccggccaaccccgagcggcacauccgcgugaacgggacccacguguacgcgggcgacaacaucggccucuuccccgucuccgccgggagcaucgcccugcggggcggguacgccgagcugggcuccagcuuccaccacgcccgcguguacaagaucaccuccgggaagaagcccgcguucgccaugcuccgcguguacacgaucgaccugcugccguaccggaaccaggaccucuucagcgucgagcugaagccccagaccauguccaugcgccaggccgagaagaagcugcgggacgcccucgcgaccggcaacgccgaguaccugggcuggcuggugguggacgacgagcucgucguggacaccagcaagaucgccacggaccaggugaaggccgucgaggccgagcuggggaccauccgccgguggcgcguggacggcuucuucucccccagcaagcugcggcuccgcccccugcagauguccaaggaggggaucaagaaggagagcgcgccggagcuguccaagaucaucgaccggcccggcuggcuccccgccgucaacaagcuguucagcgacgggaacgugaccgugguccgccgggacucccugggccgcgugcggcucgagagcaccgcccaccuccccgugacguggaagguccagaagcgcccggccgccaccaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2534 - RNA, 3281 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcggcccggauccuggccuucgacaucggcaucagcuccaucgggugggccuucagcgagaacgacgagcucaaggacugcggcgugcgcaucuucaccaagguggagaaccccaagaccggggagucccuggcccugccccggcgccucgcgcggagcgcccgcaagcggcuggcccgccggaaggcccgccugaaccaccucaagcaccugaucgcgaacgaguucaagcugaacuacgaggacuaccaguccuucgacgagagccucgccaaggccuacaagggcucccugaucagccccuacgagcugcgguuccgcgcccucaacgagcugcuguccaagcaggacuucgcccgggucauccuccacaucgcgaagcgccggggcuacgacgacaucaagaacagcgacgacaaggagaagggggccauccugaaggccaucaagcagaacgaggagaagcuggccaacuaccaguccgugggcgaguaccucuacaaggaguacuuccagaaguucaaggagaacagcaaggaguucacgaacgugcgcaacaagaaggaguccuacgagcggugcaucgcccagagcuuccugaaggacgagcugaagcucaucuucaagaagcagcgcgaguucggguucuccuucagcaagaaguucgaggaggagguccuguccguggcguucuacaagcgggcccugaaggacuucagccaccucgugggcaacugcuccuucuucaccgacgagaagcgcgccccgaagaacagcccccuggccuucauguucgucgcccugacccggaucaucaaccuccugaacaaccugaagaacaccgaggggauccucuacacgaaggacgaccugaacgcgcugcucaacgaggugcugaagaacggcacccugaccuacaagcagaccaagaagcuccugggccugagcgacgacuacgaguucaagggggagaagggcacguacuucaucgaguucaagaaguacaaggaguucaucaaggcccucggggagcacaaccugucccaggacgaccugaacgagaucgccaaggacaucacccucaucaaggacgagaucaagcugaagaaggcccuggccaaguacgaccucaaccagaaccagaucgacagccuguccaagcuggaguucaaggaccaccucaacaucagcuucaaggcgcugaagcuggugacgccccugaugcucgagggcaagaaguacgacgaggccugcaacgagcugaaccugaaggucgccaucaacgaggacaagaaggacuuccuccccgccuucaacgagaccuacuacaaggacgaggugaccaacccggugguccugcgcgcgaucaaggaguaccgcaaggugcugaacgcccuccugaagaaguacggcaaggugcacaagaucaacaucgagcuggcccgggaggucgggaagaaccacucccagcgcgccaagaucgagaaggagcagaacgagaacuacaaggccaagaaggacgcggagcucgagugcgagaagcugggccugaagaucaacagcaagaacauccucaagcugcggcuguucaaggagcagaaggaguucugcgccuacuccggggagaagaucaagaucagcgaccuccaggacgagaagaugcuggagaucgaccacaucuaccccuacucccgcagcuucgacgacuccuacaugaacaaggugcugguguucaccaagcagaaccaggagaagcucaaccagacccccuucgaggccuucggcaacgacagcgccaaguggcagaagaucgagguccuggccaagaaccugcccaccaagaagcagaagcggauccucgacaagaacuacaaggacaaggagcagaagaacuucaaggaccgcaaccugaacgacacgcgguacaucgcgcgccuggugcucaacuacaccaaggacuaccuggacuuccugccgcucuccgacgacgagaacaccaagcugaacgacacccagaaggggagcaaggugcacgucgaggccaaguccggcaugcugacgagcgcccuccggcacaccuggggcuucuccgccaaggaccgcaacaaccaccuccaccacgccaucgacgcggugaucaucgccuacgccaacaacagcaucgucaaggccuucuccgacuucaagaaggagcaggagagcaacagcgcggagcuguacgccaagaagaucuccgagcuggacuacaagaacaagcggaaguucuucgagcccuucagcggguuccgccagaaggugcuggacaagaucgacgagaucuucguguccaagcccgagcggaagaagcccagcggcgcccugcacgaggagaccuuccgcaaggaggaggaguucuaccaguccuacgggggcaaggaggggguccucaaggcccuggagcugggcaagauccggaaggugaacggcaagaucgugaagaacggggacauguuccgcgucgacaucuucaagcacaagaagaccaacaaguucuacgccgugccgaucuacacgauggacuucgcgcucaaggugcugcccaacaaggccgucgcccggagcaagaagggcgagaucaaggacuggauccugauggacgagaacuacgaguucugcuucucccucuacaaggacagccugauccugauccagaccaaggacaugcaggagcccgaguucguguacuacaacgccuucaccuccagcaccgugucccucaucgucagcaagcacgacaacaaguucgagacgcuguccaagaaccagaagauccuguucaagaacgccaacgagaaggaggugaucgccaagagcaucgggauccagaaccucaagguguucgagaaguacaucgucuccgcgcugggcgaggugaccaaggccgaguuccgccagcgggaggacuucaagaagaagcgccccgccgccaccaagaaggcggggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2535 - RNA, 3692 nt, Artificial Sequence
  Cas9 variant mRNA product
gggagagucccgcagucggcguccagcggcucugcuuguucgugugugugucguugcaggccuuauucaagcuuaccauggcccccaagaagaagcgcaaggugggcauccacggggucccggccgcgagcgaccuggugcucggccuggacaucgggaucggcuccgugggggucggcauccugaacaaggugaccggcgagaucauccacaagaacagccggaucuuccccgccgcccaggccgagaacaaccucgugcgccggaccaaccgccaggggcggcgccuggcccggcgcaagaagcaccggcgcguccggcugaaccgccucuucgaggaguccggccugaucacggacuucaccaagaucagcaucaaccugaaccccuaccagcuccgggugaaggggcugaccgacgagcuguccaacgaggagcuguucaucgcgcugaagaacauggugaagcaccgcggcaucagcuaccuggacgacgccuccgacgacgggaacagcuccgucggcgacuacgcccagaucgugaaggagaacagcaagcagcucgagaccaagacgcccggccagauccagcuggagcgguaccagaccuacgggcagcugcgcggcgacuucaccguggagaaggacgggaagaagcaccggcucaucaacgucuucccgaccuccgccuaccgcagcgaggcgcugcggauccugcagacgcagcaggaguucaacccccagaucaccgacgaguucaucaaccgcuaccucgagauccugaccggcaagcggaaguacuaccacggccccgggaacgagaagucccgcaccgacuacggccgcuaccggacgagcggggagacccuggacaacaucuucggcauccucaucgggaagugcaccuucuaccccgacgaguuccgcgccgccaaggccuccuacaccgcccaggaguucaaccugcugaacgaccucaacaaccugacggugccgaccgagaccaagaagcugagcaaggagcagaagaaccagaucaucaacuacgugaagaacgagaaggcgaugggccccgccaagcuguucaaguacaucgccaagcuccuguccugcgacgucgccgacaucaagggcuaccggaucgacaagagcgggaaggccgagauccacaccuucgaggcguaccgcaagaugaagacgcucgagacccuggacaucgagcagauggaccgggagacccuggacaagcucgccuacgugcugacccugaacacggagcgcgagggcauccaggaggcccucgagcacgaguucgccgacggguccuucagccagaagcaggucgacgagcuggugcaguuccggaaggccaacagcuccaucuucggcaagggguggcacaacuucagcgugaagcugaugauggagcucauccccgagcuguacgagaccuccgaggagcagaugaccauccugacccgccucggcaagcagaagacgaccagcuccagcaacaagaccaaguacaucgacgagaagcugcugaccgaggagaucuacaaccccguggucgcgaaguccgugcggcaggccaucaagaucgugaacgccgccaucaaggaguacggcgacuucgacaacaucgucaucgagauggcccgcgagacgaacgaggacgacgagaagaaggcgauccagaagauccagaaggccaacaaggacgagaaggacgccgccaugcucaaggcggccaaccaguacaacgggaaggccgagcugccgcacagcguguuccacggccacaagcagcuggccaccaagauccggcuguggcaccagcagggggagcgcugccucuacaccggcaagaccaucuccauccacgaccugaucaacaacagcaaccaguucgaggucgaccacauccugccccucuccaucacguucgacgacagccuggccaacaaggugcugguguacgcgaccgccaaccaggagaaggggcagcggacccccuaccaggcccucgacuccauggacgacgccuggagcuuccgcgagcugaaggccuucguccgggaguccaagacccugagcaacaagaagaaggaguaccuccugaccgaggaggacaucuccaaguucgacgugcgcaagaaguucaucgagcggaaccugguggacacgcgcuacgcgagccgggucgugcucaacgcccugcaggagcacuuccgcgcccacaagaucgacaccaagguguccgucgugcgcggccaguucaccagccagcugcggcgccacuggggcaucgagaagacccgggacacguaccaccaccacgccguggacgcccucaucaucgcggccagcucccagcugaaccuguggaagaagcagaagaacacccucgucagcuacuccgaggaccagcugcuggacaucgagaccggggagcucaucagcgacgacgaguacaaggaguccguguucaaggcccccuaccagcacuucguggacacccucaagagcaaggaguucgaggacuccauccuguucagcuaccaggucgacuccaaguucaaccgcaagaucagcgacgccacgaucuacgcgacccggcaggccaaggugggcaaggacaaggccgacgagaccuacgugcucgggaagaucaaggacaucuacacccaggacggcuacgacgccuucaugaagaucuacaagaaggacaaguccaaguuccugauguaccgccacgacccgcagacguucgagaaggucaucgagcccauccuggagaacuaccccaacaagcagaucaacgagaagggcaaggaggugcccugcaacccguuccucaaguacaaggaggagcacggguacauccggaaguacagcaagaagggcaacgggcccgagaucaagucccugaaguacuacgacagcaagcugggcaaccacaucgacaucacccccaaggacuccaacaacaaggugguccuccagagcgugucccccuggcgcgccgacguguacuucaacaagaccaccgggaaguacgagauccugggccugaaguacgcggaccuccaguucgagaagggcacggggaccuacaagaucagccaggagaaguacaacgacaucaagaagaaggagggcgucgacagcgacuccgaguucaaguucacccuguacaagaacgaccugcuccuggugaaggacaccgagacgaaggagcagcagcuguuccgguuccucagccgcaccaugccgaagcagaagcacuacguggagcugaagcccuacgacaagcagaaguucgagggcggggaggcccugaucaagguccucgggaacguggccaacuccggccagugcaagaagggccugggcaagagcaacaucuccaucuacaaggugcggaccgacguccuggggaaccagcacaucaucaagaacgagggggacaagcccaagcucgacuucaagcgccccgccgccaccaagaaggcgggccaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2536 - RNA, 4250 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcgacccaguucgagggcuucaccaaccuguaccaggugagcaagacgcuccgguucgagcugaucccccaggggaagacccugaagcacauccaggagcagggcuucaucgaggaggacaaggcccgcaacgaccacuacaaggagcucaagcccaucaucgaccggaucuacaagaccuacgccgaccagugccugcagcuggugcagcucgacugggagaaccuguccgccgccaucgacagcuaccgcaaggagaagaccgaggagacgcggaacgcgcugaucgaggagcaggccaccuaccgcaacgccauccacgacuacuucaucgggcggaccgacaaccucaccgacgccaucaacaagcgccacgcggagaucuacaagggccuguucaaggccgagcuguucaacggcaagguccucaagcagcuggggacggugaccaccaccgagcacgagaacgcccugcuccgguccuucgacaaguucacgaccuacuucagcggcuucuacgagaaccgcaagaacguguucuccgccgaggacaucagcaccgccaucccccaccggaucguccaggacaacuucccgaaguucaaggagaacugccacaucuucacccgccugaucacggcggugcccucccugcgggagcacuucgagaacgugaagaaggccaucgggaucuucgucagcaccuccaucgaggagguguucagcuuccccuucuacaaccagcuccugacccagacccagaucgaccuguacaaccagcuccugggcgggaucucccgcgaggccggcacggagaagaucaagggccugaacgaggugcucaaccuggccauccagaagaacgacgagaccgcccacaucaucgcgagccugccccaccgguucaucccccucuucaagcagauccuguccgaccgcaacacccugagcuucauccucgaggaguucaaguccgacgaggaggucauccagagcuucugcaaguacaagacccugcugcggaacgagaacgugcucgagacggccgaggcccuguucaacgagcugaacuccaucgaccucacccacaucuucaucagccacaagaagcuggagaccaucuccagcgcccugugcgaccacugggacacccuccgcaacgcccuguacgagcggcgcaucagcgagcugacggggaagaucaccaaguccgcgaaggagaaggugcagcggagccucaagcacgaggacaucaaccugcaggagaucaucuccgccgccggcaaggagcugagcgaggccuucaagcagaagaccuccgagauccucagccacgcccacgcggcccuggaccagccgcugcccaccacgcucaagaagcaggaggagaaggagauccugaagucccagcuggacagccugcucgggcuguaccaccuccucgacugguucgccgucgacgaguccaacgagguggaccccgaguucagcgcccgccugaccggcaucaagcuggagauggagccgucccucagcuucuacaacaaggcgcgcaacuacgccaccaagaagcccuacuccguggagaaguucaagcugaacuuccagaugcccacccuggccagcggcugggacgucaacaaggagaagaacaacggggccauccucuucgugaagaacggccuguacuaccuggggaucaugcccaagcagaagggccgguacaaggcccucuccuucgagccgacggagaagaccagcgagggguucgacaagauguacuacgacuacuuccccgacgcggccaagaugauccccaagugcuccacccagcugaaggccgugaccgcccacuuccagacccacacgacccccauccugcucagcaacaacuucaucgagccgcuggagaucaccaaggagaucuacgaccugaacaaccccgagaaggagcccaagaaguuccagaccgccuacgcgaagaagacgggcgaccagaagggcuaccgcgaggcccucugcaaguggaucgacuucacccgggacuuccuguccaaguacaccaagaccacgagcaucgaccugagcucccuccgccccagcucccaguacaaggaccugggggaguacuacgccgagcugaacccgcuccuguaccacaucagcuuccagcggaucgccgagaaggagaucauggacgccgucgagaccggcaagcuguaccucuuccagaucuacaacaaggacuucgcgaaggggcaccacggcaagcccaaccugcacacccuguacuggaccggccucuucucccccgagaaccuggccaagacgagcaucaagcugaacgggcaggccgagcuguucuaccgccccaagucccggaugaagcgcauggcccaccggcugggcgagaagaugcugaacaagaagcucaaggaccagaagaccccgauccccgacacccuguaccaggagcuguacgacuacgugaaccaccgccucagccacgaccuguccgacgaggcgcgggcccugcuccccaacgugaucaccaaggaggucagccacgagaucaucaaggaccgccgguucacguccgacaaguucuucuuccacgugccgaucacccugaacuaccaggccgccaacagccccuccaaguucaaccagcgcgucaacgccuaccugaaggagcaccccgagacccccaucaucgggaucgaccggggcgagcgcaaccucaucuacaucaccgugaucgacagcacggggaagauccuggagcagcggucccugaacaccauccagcaguucgacuaccagaagaagcucgacaaccgcgagaaggagcggguggcggcccgccaggccuggagcgucgugggcaccaucaaggaccugaagcagggguaccugucccaggugauccacgagaucgucgaccucaugauccacuaccaggccguggugguccuggagaaccugaacuucggcuucaagagcaagcgcaccggcaucgccgagaaggcgguguaccagcaguucgagaagaugcucaucgacaagcugaacugccuggugcucaaggacuacccggccgagaaggucgggggcgugcugaaccccuaccagcugacggaccaguucaccagcuucgccaagauggggacccaguccggcuuccucuucuacgugcccgcccccuacaccagcaagaucgacccgcugacgggcuucgucgaccccuucguguggaagaccaucaagaaccacgagucccggaagcacuuccuggagggguucgacuuccuccacuacgacgugaagaccggcgacuucauccugcacuucaagaugaaccgcaaccugagcuuccagcgggggcuccccggcuucaugcccgccugggacaucgucuucgagaagaacgagacccaguucgacgcgaaggggacgccguucaucgccggcaagcgcaucgugcccgugaucgagaaccaccgguucaccggccgcuaccgggaccuguaccccgccaacgagcugaucgcccuccuggaggagaaggggaucgucuuccgcgacggcuccaacauccugcccaagcuccuggagaacgacgacagccacgcgaucgacaccaugguggcccugauccgguccgugcuccagaugcgcaacagcaacgccgccaccggggaggacuacaucaacuccccgguccgggaccugaacggcgugugcuucgacagccgcuuccagaaccccgaguggcccauggacgccgacgcgaacggggccuaccacaucgcccugaagggccagcuccugcugaaccaccucaaggaguccaaggaccugaagcugcagaacggcaucagcaaccaggacuggcucgccuacauccaggagcugcggaacaagcgccccgccgcgacgaagaaggccgggcaggccaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2537 - RNA, 4229 nt, Artificial Sequence
  Cpf1 variant mRNA product
gggagagucccgcagucggcguccagcggcucugcuuguucgugugugugucguugcaggccuuauucaagcuuaccauggcccccaagaagaagcgcaaggugggcauccacggggucccggccgcgagcaucuaccaggaguucgugaacaaguacucccugagcaagacccuccgguucgagcugaucccccagggcaagacccuggagaacaucaaggcccgcgggcucauccuggacgacgagaagcgggccaaggacuacaagaaggccaagcagaucaucgacaaguaccaccaguucuucaucgaggagauccuguccagcgugugcaucuccgaggaccuccugcagaacuacagcgacgucuacuucaagcugaagaaguccgacgacgacaaccuccagaaggacuucaagagcgccaaggacacgaucaagaagcagaucuccgaguacaucaaggacagcgagaaguucaagaaccuguucaaccagaaccugaucgacgcgaagaagggccaggaguccgaccucauccuguggcugaagcagagcaaggacaacgggaucgagcuguucaaggccaacuccgacaucaccgacaucgacgaggcccucgagaucaucaagagcuucaagggcuggaccaccuacuucaagggcuuccacgagaaccgcaagaacguguacuccagcaacgacauccccacguccaucaucuaccggaucguggacgacaaccugcccaaguuccucgagaacaaggccaaguacgagagccugaaggacaaggcgccggaggccaucaacuacgagcagaucaagaaggaccuggccgaggagcucaccuucgacaucgacuacaagaccuccgaggucaaccagcgcguguucagccuggacgagguguucgagaucgccaacuucaacaacuaccugaaccagagcgggaucaccaaguucaacacgaucaucggcgggaaguucgucaacggcgagaacaccaagcggaaggggaucaacgaguacaucaaccucuacucccagcagaucaacgacaagacccugaagaaguacaagaugagcgugcuguucaagcagauccucuccgacaccgagagcaaguccuucgugaucgacaagcuggaggacgacagcgacgucgugacgaccaugcaguccuucuacgagcagaucgccgcguucaagaccguggaggagaaguccaucaaggagacccugucccuccuguucgacgaccugaaggcccagaagcucgaccugagcaagaucuacuucaagaacgacaagucccugacggaccucagccagcaggucuucgacgacuacuccgugaucggcaccgccgugcuggaguacaucacccagcagaucgcccccaagaaccuggacaaccccagcaagaaggagcaggagcucaucgccaagaagaccgagaaggcgaaguaccugucccuggagacgaucaagcucgcccuggaggaguucaacaagcaccgcgacaucgacaagcagugccgguucgaggagauccuggccaacuucgccgccauccccaugaucuucgacgagaucgcgcagaacaaggacaaccucgcccagaucagcaucaaguaccagaaccagggcaagaaggaccugcugcaggccuccgccgaggacgacgucaaggccaucaaggaccuccuggaccagaccaacaaccugcugcacaagcucaagaucuuccacaucagccaguccgaggacaaggcgaacauccuggacaaggacgagcacuucuaccugguguucgaggagugcuacuucgagcucgccaacaucgugccgcuguacaacaagauccgcaacuacaucacccagaagcccuacagcgacgagaaguucaagcugaacuucgagaacagcacccucgccaacgggugggacaagaacaaggagcccgacaacacggccauccuguucaucaaggacgacaaguacuaccugggcgucaugaacaagaagaacaacaagaucuucgacgacaaggcgaucaaggagaacaagggggagggcuacaagaagaucguguacaagcuccugcccggcgccaacaagaugcugccgaagguguucuucuccgccaagagcaucaaguucuacaaccccuccgaggacauccuccggauccgcaaccacagcacccacaccaagaacgggagcccccagaagggcuacgagaaguucgaguucaacaucgaggacugccggaaguucaucgacuucuacaagcagagcaucuccaagcaccccgaguggaaggacuucggguuccgcuucagcgacacccagcgguacaacuccaucgacgaguucuaccgcgaggucgagaaccagggcuacaagcugacguucgagaacaucagcgaguccuacaucgacagcguggucaaccaggggaagcuguaccucuuccagaucuacaacaaggacuucuccgccuacagcaagggccggccgaaccugcacacccuguacuggaaggcccucuucgacgagcgcaaccugcaggacgugguguacaagcugaacggcgaggcggagcuguucuaccggaagcaguccauccccaagaagaucacccaccccgccaaggaggccaucgccaacaagaacaaggacaaccccaagaaggagagcgucuucgaguacgaccucaucaaggacaagcgcuucaccgaggacaaguucuucuuccacugcccgaucacgaucaacuucaaguccagcggggccaacaaguucaacgacgagaucaaccugcuccugaaggagaaggcgaacgacgugcacauccugagcaucgaccggggcgagcgccaccucgccuacuacacccugguggacgggaagggcaacaucaucaagcaggacaccuucaacaucaucgggaacgaccgcaugaagaccaacuaccacgacaagcuggccgccaucgagaaggaccgggacuccgcccgcaaggacuggaagaagaucaacaacaucaaggagaugaaggagggcuaccucagccaggucgugcacgagaucgcgaagcuggugaucgaguacaacgccaucgucguguucgaggaccugaacuucggcuucaagcgggggcgcuucaagguggagaagcaggucuaccagaagcucgagaagaugcugaucgagaagcugaacuaccucguguucaaggacaacgaguucgacaagacgggcggggugcugcgggccuaccagcugaccgcccccuucgagaccuucaagaagaugggcaagcagaccgggaucaucuacuacguccccgcgggcuucaccuccaagaucugccccgugacgggcuucgugaaccagcucuacccgaaguacgagagcgucuccaagagccaggaguucuucuccaaguucgacaagaucugcuacaaccuggacaagggguacuucgaguucagcuucgacuacaagaacuucggcgacaaggccgccaaggggaaguggaccaucgccuccuucggcagccgccugaucaacuuccggaacuccgacaagaaccacaacugggacacccgcgagguguaccccaccaaggagcucgagaagcugcugaaggacuacagcaucgaguacggccacggggagugcaucaaggccgcgaucugcggcgaguccgacaagaaguucuucgccaagcucacgagcgugcugaacaccauccugcagaugcggaacuccaagaccgggaccgagcucgacuaccugaucagccccgucgccgacgugaacggcaacuucuucgacucccgccaggcccccaagaacaugccgcaggacgccgacgcgaacggggccuaccacaucggccugaagggccucaugcugcuggggcggaucaagaacaaccaggagggcaagaagcucaaccuggugaucaagaacgaggaguacuucgaguucguccagaaccgcaacaacaagcggcccgccgccacgaagaaggccgggcaggcgaagaagaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 2538 - RNA, 51 nt, Artificial Sequence
  NLS2 variant
auggcccccaagaaaaagagaaaagugggcauccacggggucccugcugca

SEQ ID NO: 2539 - RNA, 48 nt, Artificial Sequence
  NLS4 variant
aagagacccgccgcuaccaaaaaggcaggccaggccaaaaagaaaaag

SEQ ID NO: 2540 - RNA, 4107 nt, Artificial Sequence
  Cas9 variant
auggacaagaaauacagcaucggccuggauauugggaccaacuccgugggaugggccgucauaacagacgaguauaagguucccucuaaaaaguucaaagugcucgguaauacugauagacacucaaucaagaagaaccuuauuggcgcucuguuguuugacaguggggaaacggcagaggccaccagguuaaaacggacagcgcgccgacguuacacuagaaggaagaaucggaucugcuaucugcaggaaauuuucagcaacgagauggcuaaaguagaugacuccuuuuuccaucgccuagaagagucuuuucucguggaggaagauaagaaacacgagagacauccuaucuucggaaauauagucgacgaaguggccuaccacgagaaguauccaaccaucuaccaucugaggaagaaacuuguugauucgacagacaaggcagaucugcgguugauuuaucucgcccuggcucacaugaucaaauuucgcggccacuuccugauugagggugaccucaacccggauaauucagacguggacaaguuauuuauccaacugguccagaccuacaaccagcuuuucgaagagaaucccauaaacgcaagcgggguggaugccaaagcuauuuugagugcccgacuguccaagucuagaaggcuagaaaaucucaucgcgcagcugccuggagagaaaaagaacggccuuuuuggcaaucugauugcauugagccucgggcugacuccaaacuucaaguccaauuuugacuuagccgaagaugcuaaacugcaacucucaaaggacacauacgaugacgaucuugacaaccuguuggcccagaucggagaucaguaugcagaccuauuccuggcugccaaaaaccucagugaugcgauccugcuuagcgacauucugcggguaaauaccgagauaacgaaggcccccuugucugcauccaugaucaaacguuacgacgagcaucaccaggaucucacucuguuaaaggcucugguucgccaacagcuaccugaaaaguauaaagagauuuucuuugaccagucaaagaacgguuacgccggcuauaucgaugggggagcuagccaggaagaguucuacaaauuuauaaagccaauucucgaaaagauggacggcaccgaggagcugcuugugaaguugaauagagaagaucugcucaggaagcaacggacauucgacaacgguaguaucccccaucagauccaccugggggagcuucacgccauucugcgacgccaggaagauuuuuauccuuucuugaaagacaauagagagaagaucgagaaaauucucacuuuuaggauaccauacuacgucggaccgcuggcacggggcaacucucgcuucgccuggaugaccagaaaguccgaagagacaaucacccccuggaauuuugaagaggugguggauaaaggcgcuagcgcgcaaucguucauugaaaggaugacgaacuuugacaagaauuuaccuaacgagaagguccugccaaaacauucucuacucuaugaguacuucacuguuuauaaugaacugacaaaggugaaauacguaaccgaggggaugcguaagcccgcauuucuuuccggagaacagaaaaaggccaucguggauuugcuguucaaaacuaaccggaaggucacagugaagcagcucaaagaggacuauuucaagaaaaucgaauguuuugauucaguugagauuagugguguggaggaccgauucaaugcuagccugggcaccuaccacgacuuacugaagauaaucaaagauaaggacuuucuugauaacgaagagaaugaagacauuuuggaggauaucguccucacgcugacccuauucgaagacagagagaugauugaggaaaggcugaagacauaugcccaucucuuugaugacaaagugaugaagcagcugaaacgccggagauacacuggguggggaaggcuuucccgcaaguugaucaacggcauacgagauaaacaaucugguaagaccauccuggacuucuuaaagagcgauggguuugcaaaccggaauuucaugcagcucauucacgacgauucacugacauuuaaagaggacauccagaaggcccagguaaguggccaaggagacucccuucaugaacacauugcuaaccuggccggcagcccugcaaucaaaaaggggauauugcagacuguuaaaguggucgaugagcucgugaaggucaugggacgucacaagccagaaaauauugugaucgagauggcgagagagaaccagaccacacagaaaggucaaaagaacucuagggaacgcaugaaacggauugaggaaggcaucaaggagcuggggucacagauacuaaaagagcaucccguugaaaauacccagcugcagaaugagaagcucuaccuguauuaccuucaaaacggaagagacauguauguggaucaggaauuggacaucaauaggcugagugauuacgacguagaucacauugucccgcagagcuucuuaaaagacgauuccaucgacaacaaggugcucacucgaucugauaagaaucgcggcaaaucggacaacguuccuagcgaggaaguggucaagaaaaugaagaauuauuggcggcaacugcuuaacgcuaaacugauuacgcagagaaaguuugacaaucuaacaaaggccgagaggggugggcucuccgagcuggauaaagcaggcuucaucaagcgucaguugguggaaacccgccagauaacuaaacauguagcccaaauucuggacucacggaugaacaccaaguacgaugagaacgacaaauuaaucagagaagugaagguuaucacacucaagaguaaacuggucucugauuuuaggaaggacuuccaguucuauaaagugcgagagauuaauaacuaccaccacgcucaugaugccuaccuuaaugcaguggucggaaccgcucugaucaagaaauaucccaaguuggaaagcgaguuuguuuacggcgacuauaagguguacgaugugcggaaaaugauugccaaguccgagcaggaaauagggaaagcgacugccaaguauuucuuuuacucaaacaucaugaauuucuuuaaaacagagauuacgcucgcuaacggagaaauccgcaagagaccacugauugagaccaauggugaaacuggcgagaucguaugggacaaggggagggauuucgcaacaguccggaaagugcuaagcaugccucagguuaacauagugaagaaaaccgagguccaaacaggaggcuuuucuaaggaauccauccugcccaaacgaaauagugacaaacuuauugcccgcaaaaaggauugggacccaaagaaauaugguggguucgacagccccacuguggcuuacucuguucucgugguagccaaggucgagaaaggcaaguccaaaaagcugaagucagugaaagaauugcugggaaucaccauuauggagagaaguagcuuugagaagaacccuaucgauuucuuagaagcaaaaggcuacaaggaggugaaaaaggaccucauaauuaagcugccaaaauauucgcuuuuugaacuggagaaugggaggaagcguauguuggcguccgccggagaacuccagaaaggcaacgagcuggcucuaccgucuaaguacgucaauuuccuguaucuugccagccacuacgagaaacucaaggguucacccgaagauaacgagcagaagcagcuguucguugaacaacauaaacacuauuuggacgagaucaucgaacagauuagugaguuuuccaagcgggugauauuagcagaugcuaaucuggacaaaguacucucugccuacaacaagcauagagauaaaccuaucagggagcaggcagaaaacauuauccaccuguucacgcuuaccaaucugggggccccagcugcguuuaaguauuucgacacaacuauugaucgcaaacgauacaccagcacaaaggagguguuggacgccacucuaauccaccaauccauaaccggacuguacgaaacgagaaucgaucucucacagcugggcggugacuga

SEQ ID NO: 2541 - RNA, 4890 nt, Artificial Sequence
  Cas9 variant
augaacuucaagauccugcccauugccauagaccucggcgugaaaaauaccggggucuuuagcgcuuucuaccagaagggaacaucccuugagagacuggauaacaaaaaugguaagguuuaugaauugucuaaagacucauacacuuuacugaugaacaauaggacggcacggcgccaccaacgacguggcaucgauagaaagcagcuagugaagaggcucuuuaaacugauuuggaccgagcagcuuaaccuggaaugggacaaggauacacagcaagccaucaguuucuuguuuaaucggcgcggguucagcuuuauuacugacggauauuccccugaguaccucaacaucguaccagaacaggugaaagcgauacugauggauaucuucgacgauuauaauggcgaggacgaucuggacucuuaccucaaguuagcuaccgagcaggaaucgaaaauuucagagaucuauaacaagcugaugcagaagauucuugaauuuaaauugaugaagcugugcacagauaucaaagacgacaaggucagcaccaaaacucuaaaggagauaacaaguuacgaguucgaacuccuggccgauuaccuugcaaauuauuccgagucucugaaaacccaaaaguuuagcuacacggacaagcaggguaacuugaaagaacucuccuauuaccaucacgauaaguauaauauucaggaguuccugaaaagacaugccacuaucaacgacaggauuuuagauacccugcucacagacgaucuugacaucuggaauuuuaacuucgaaaaguucgauuuugacaaaaacgaggagaagcugcagaaucaagaagauaaggaccacauccaggcucauuugcaccacuucguguuugcaguuaacaaaauuaagucagagauggccagugggggacggcaucgcagccaguacuuccaagaaauaacuaaugugcuagacgagaacaaucaccaggaaggcuaucugaaaaacuuuugugagaaucuccauaacaagaaauacucuaaucuguccgucaagaaccuugugaaucugaucggcaacuugucaaaucucgagcugaagccguuacgaaaauacuucaacgauaagauucacgcuaaagccgaccacugggaugaacagaaguuuaccgagacauauugccauuggauccugggggaauggagaguaggaguuaaagaccaggauaagaaggacggugcgaaauacagcuauaaggaucuauguaaugagcucaaacaaaaggugaccaaagcaggccuggucgacuuccuuuuggaacuggaucccugcaggacgauaccuccauaccucgacaacaacaaucggaagcccccuaaaugucagagucugauucuuaacccaaaguuucuggauaaucaguaucccaacuggcagcaauacuugcaggagcucaagaaacugcagucuauccagaauuauuuagacuccuucgagacugaucugaaggugcuaaaaagcucgaaggaccaaccuuacuuuguggaauacaaaucuuccaaccagcagaucgccucagggcagcgugacuauaaggaucucgacgcucgcauucugcaauucaucuuugauagagucaaggccagugacgagcuuuugcugaaugaaauuuacuuccaggcuaaaaagcucaaacagaaggcuagcuccgagcuggagaaauuagaaucuagcaagaagcuggaugagguuauagccaacucacaacuuagucagaucuugaaaucccagcacacaaauggaauuuucgaacagggcaccuuucuccaucuggugugcaaguauuacaaacaaaggcagcgggcgcgagacagccgccuauauaucaugccagaguacagauaugauaagaaacugcacaaguacaacaauacugguagguucgacgaugacaaccagcuccugacauacuguaaucauaagccgcggcagaaacgcuaucaacuuuugaacgaucuggccgggguauuacaggugucucccaauuuucucaaggacaaaaucggaucagaugacgaccuguucauuaguaaguggcuugucgaacacauaagaggcuuuaaaaaggcaugcgaggauagccugaaaauccagaaggacaacaggggcuugcucaaccacaagauuaauaucgcucguaacaccaaagggaagugugagaaagaaauuuucaaucugaucugcaagauagagggauccgaagauaaaaaggguaacuacaagcauggccuagccuaugagcugggggugcuccuguuuggagaaccuaaugaggcuucuaaaccagaguucgaccggaagaucaaaaaguuuaacucgauuuacagcuucgcccagauccaacagauugcauuugccgaacgaaaaggcaaugcuaacacgugugcgguuugcuccgcagauaaugcccacagaaugcagcaaaucaagauaaccgagcccguggaagacaacaaggauaaaauuauccuuucagcuaaggcccagagguugccugcaauuccaacacgcaucgucgacggugccgugaaaaagauggcuacuauacuggccaaaaauaucguagaugacaacuggcagaauauuaagcagguuuuaagugcaaagcaucaacuccacauccccauuaucaccgagucuaacgcguucgaauuugagccggcucuggccgaugugaaagggaaaagccuuaaagaccggagaaagaaagcacuggagaggauauccccugaaaauauuuucaaggacaagaacaaccgcaucaaagaguucgccaagggcaucucagcuuauagcggagccaaucuaacagauggcgacuuugauggggcaaaagaagaacucgaccacauuaucccccgaucucauaagaaauacggaacucugaacgaugaggcuaauuugauuugcgucacccggggugacaacaagaauaaaggcaaccguauauucugucugagagauuuagccgacaauuauaagcucaagcaguuugaaacaaccgaugaccuggagaucgaaaagaagauugcggauacuaucugggacgccaacaaaaaggauuucaaauuugggaauuacagguccuucauuaaccuuacgccacaggagcagaaggcuuuucgccacgcacuguucuuggccgacgaaaauccuaucaagcaagcugugauacgggccaucaacaauagaaacaggacauuugucaauggaacccagcgauacuucgcagaggugcucgcgaacaauauuuaucugcgcgccaaaaaggagaaccuaaacacugacaaaaucaguuuugauuacuucggcauucccaccaucgguaaugggcggggcauagcugaaauuagacagcuguaugagaagguugacagcgauauccaggccuacgcaaaaggagacaagccacaagcaucuuauucccaucuuaucgaugccaugcucgcauucugcauugccgcugacgaacacaggaacgauggcucaauagggcuggagaucgacaagaauuacaguuuguauccccuggauaaaaacacaggagaaguguuuaccaaggacauuuucagccagaucaaaauuacugauaaugaguuuucggacaagaaauuaguacguaagaaggcgaucgaggguuucaacacacaucgccagaugacgcgggauggcauauacgccgaaaauuaccucccuauccugauucacaaagagcuuaacgaagucagaaagggguauaccuggaaaaauuccgaggaaaucaagauuuuuaaaggaaagaaauacgacauccagcaacugaacaauuugguguauugucucaaguucguugacaagccaauaucuauugauauccagaucagcacucuggaggagcuaaggaacauucugacaaccaauaacaucgcagcuacagccgaauacuauuacauaaaucuuaaaacucagaagcuccacgaguauuacauugaaaacuacaacaccgcccugggcuauaaaaaguacucaaaagagauggaguuuuugcgaaguuuagcuuaucgguccgaacgcgugaagaucaagucuauugacgaugucaaacaagugcuggacaaggauagcaauuucaucauagguaaaauuacgcucccguuuaagaaagaguggcagagacuguacagggaauggcagaacaccacaaucaaggacgauuaugaguuccuuaaguccuuuuucaauguaaaaucaaucacuaagcugcauaaaaaggugcggaaagacuuuagcuugcccauuaguaccaacgaagggaaguuccuaguuaagcgaaaaacaugggauaauaacuucaucuaccagauucugaaugacucugauuccagagcagacggcacuaagccuuuuauaccagccuucgacaucagcaaaaacgagauugucgaggcgaucaucgauucguuuaccucaaagaauauuuucuggcuccccaaaaacauagaacugcaaaagguggacaauaaaaacaucuuugcuauugauacgucuaagugguucgagguggaaacaccuagugaccuucgcgauaucggaauugccaccauccaguauaagauagacaauaacuccaggccaaaaguccguguuaaguuagauuacgugaucgacgaugacagcaaaauuaauuacuuuaugaaccacucucugcucaagagccgguaucccgauaaaguguuggagauccugaagcaguccacuauuaucgaguucgagucaaguggcuuuaacaagacaauaaaagagaugcucgggaugaagcuggcaggaauuuacaaugaaaccagcaacaauuga

SEQ ID NO: 2542 - RNA, 3162 nt, Artificial Sequence
  Cas9 variant
augaagagaaacuacauccugggccucgacauugggauaaccagcgugggauaugguaucauugauuacgagacaagggacgucaucgaugccggcguucggcuuuucaaagaagcuaauguggagaacaaugaagggcgccgauccaagcguggagcaagaaggcugaaacggcgcagaaggcaccggauucagcgcguaaagaaauuguuauuugacuauaaccugcuaacugaucauucugagcucucaggcaucaaucccuacgaagcccgagugaagggucugagucaaaaacuuagcgaggaggaguucuccgcggcucuguugcaccucgccaaaagaaggggaguccauaacgugaaugaaguugaagaggacacggggaacgagcugucuaccaaggaacagauaucgcguaauucaaaagcacuggaggaaaaguauguggccgagcuccaguuagaacggcugaaaaaggauggcgagguccgcggcagcaucaacagauuuaagacaagugacuacgugaaagaggcuaagcagcuuuugaaaguacaaaaggcauaucaccagcuggaucaguccuucauugacacuuacaucgaucuacucgaaaccaggcggacauacuaugaggggccuggagaagguucuccauuuggcuggaaagacauuaaggagugguacgaaaugcugauggggcauugcaccuauuucccggaggagcuucgaagcguuaaauacgccuauaaugcugaucuguacaacgccuugaaugaccucaacaaucuggugaucacucgcgacgaaaacgagaaguuagaauauuacgagaaguuucagauaauugaaaacgucuucaaacaaaagaaaaagcccacacugaaacagaucgcgaaggagauucucgugaaugaggaagauaucaagggauacagagugaccuccacgggcaaaccugaguuuacuaaccuuaaggucuaucacgacaucaaagauauuaccgcaaggaaggaaauaaucgagaaugccgagcuguuggaccagauugcuaaaauccuaacaauauaccagucaagugaagauauucaagaggaacugacuaaccucaauagcgagcugacccaggaagagaucgagcagaucucuaaccuuaaggguuauacagggacccacaaucuguccuugaaggccauuaaccucauccuggacgaauuauggcauacgaaugauaaccaaauugcaauauucaaucggcugaagcuaguuccaaagaaaguggaccucucacagcagaaggagauccccacuacacugguagaugacuuuauucuuagcccuguggucaaacgcaguuucauccagucuaucaaggugauuaacgcuauaaucaagaaauacggauugccaaaugauauuaucauugaacuggccagagagaagaacuccaaagacgcgcaaaagaugaucaaugaaaugcagaaaaggaaccgucagaccaacgagcggauagaggaaaucauucgaacuacaggcaaggagaaugccaaauaucucaucgaaaagauuaagcugcacgacaugcaggagggcaaaugucuuuacagccuggaagcaauccccuuggaggaucuccugaacaauccuuuuaacuaugagguugaccauauaauuccaagaucggugucuuucgauaauuccuucaacaauaaggucuuagugaaacaagaagagaacucaaagaaagggaauaggaccccguuucaguaccugaguagcuccgacucuaagaucagcuacgaaacguucaagaaacacauucuaaaccucgcuaagggaaaaggucgcaucucaaagaccaaaaaggaguaucugcuugaggaacgggauauaaauagauuuaguguacagaaggacuucaucaacaggaauuugguugauacacgcuacgccacucgaggccugaugaaccuccugcgguccuauuuucgugugaauaacuuagacgucaaagugaaaagcauuaacgggggauucaccucuuuucugagaaggaaauggaaguucaaaaaggagcgcaauaagggcuacaaacaccaugcugaagaugcccuuaucauugcaaacgccgacuuuaucuucaaggaguggaaaaaguuggauaaagcuaagaaagucauggaaaaucagauguuugaggagaagcaagcggaaucaaugcccgagauagaaacagagcaggaauauaaggagauuuucaucacuccucaccagaucaaacauauuaaggacuuuaaagauuacaaguauagucaccggguggacaaaaagccaaacagagagcucaucaaugacacccuguacagcacaaggaaggaugacaaagguaacacccuaauuguuaauaaccugaaugggcucuacgauaaggacaacgauaaacugaagaaacuuauaaauaagucccccgaaaaguugcugauguaucaucacgacccucagacuuaccaaaaauuaaagcucaucauggagcaguauggcgaugagaaaaacccacuguacaaguauuacgaagaaacgggaaauuaucuuacaaaauacucuaagaaggacaacggccccgugauuaaaaagaucaaauacuaugggaauaagcugaacgcacacuuggauauuaccgacgauuacccgaacucgcgaaauaaaguagucaagcucagccugaagccuuaucgcuucgacguguaccuagauaacggaguuuauaaauucgugacugucaagaaucuggacgugaucaaaaaggagaacuacuaugagguaaauuccaaaugcuacgaagaggccaagaaacucaagaagauaucaaaccaggcugaauuuaucgccaguuucuacaauaacgaccugauuaaaaucaauggugagcuuuaucgggugauuggcguuaacaaugauuugcugaacagaaucgaggucaauaugauagacauuaccuacagggaauauuuagagaacaugaaugauaagcgucccccacgcaucaucaaaacaauugcaucuaagacccaaagcaucaaaaaguacuccacugacauacucgggaaccuguaugaagugaagucaaagaagcauccucagauuaucaaaaagggauga

SEQ ID NO: 2543 - RNA, 4230 nt, Artificial Sequence
  Cas9 variant
augcuguucaacaagugcaucauuauaagcaucaaucucgacuuuuccaacaaagagaaguguaugaccaaacccuacucuauuggccuugauaucgggacaaauucagugggaugggccgucauuacugacaacuauaagguuccuaguaaaaagaugaaggugcuggguaauacgagcaaaaaguacaucaaaaagaacuuguuaggcguacugcuauucgauuccgggauaaccgcugaaggaagaaggcucaaacggacagcacgccgacguuauacuagaaggcggaaucgcauccuguaccuucaggagauuuuuaguaccgaaauggccacacuggacgaugcguucuuucaaagauuggacgauucguuccucgugccagacgauaagagggacucaaaguauccgaucuuuggcaaccuggucgaggaaaaaguguaccacgaugaguuccccaccauuuaucaucugcggaaguaccucgcugacagcacuaaaaaggccgauuuacgccugguuuaccuugcauuggcccacaugaucaaauaucgaggucauuuucugauagagggggaguucaauaguaagaacaaugacauucagaaaaacuuucaggacuuccuagauacauacaaugcuaucuuugaauccgaccucucucuggaaaacagcaagcagcuugaggagauugugaaggauaaaaucuccaagcuggaaaagaaggacagaaucuugaaacucuucccuggagagaaaaauucaggcauuuucagugaauuucugaaguuaauagucggcaaccaagcagauuucaggaaaugcuuuaaccuggacgagaaggccagccuccacuucucuaaagaauccuaugaugaggaccuugagacccuguugggguacaucggagaugacuauucagauguguuucuaaaggcuaaaaagcuguacgacgccauucuccugagcgguuuccuuacgguaacugacaaugaaaccgaggcgccacugaguucugcaaugaucaagcgguauaacgaacauaaagaggauuuggcccuccugaaggaauacauacguaauauuuccuuaaaaacauacaacgagguuuuuaaggacgauacuaaaaauggcuaugcuggguacaucgacggaaagaccaaccaggaggauuucuauguguaccugaagaaucuacucgccgaauuugagggcgcagacuauuuccuggaaaagaucgaucgcgaggacuuucuuagaaagcagaggacauucgauaacgguagcauucccuaccagauccacuugcaagaaaugcgggcuauucuggacaaacaggccaaguuuuauccuuuccucgcgaaaaauaaggagcgaauagagaaaauccugaccuuccgcauuccauacuacgucgggccccuugccagaggaaacucggauuuugcauggucuaucaggaagcggaaugaaaagaucacgccuuggaacuucgaggacgugauugauaaagaauccucagcugaggccuuuauaaaucgcaugacuucuuucgaccuguauuugccagaggaaaaggugcucccgaaacacagccuguuauacgagacauuuaacgucuauaaugaacugaccaagguuagauucaucgcugaguccaugagggacuaccaguuucuagauucuaaacagaagaaggacauugugcgucucuauuucaaagauaagcggaaaguaacugacaaggauaucauugaauaccugcaugccaucuauggcuacgacggcauagagcuuaaagggaucgagaagcaauuuaacagcucauugaguacauaccacgaucugcucaacauuaucaaugacaaggaguuccuggaugacuccagcaacgaagcaauuaucgaagagauaauucauaccuuaacgaucuuugaagaucgagagaugauuaaacagagacugucuaaguucgagaauaucuuugacaaaucagugcuuaagaaauugaguaggcgccacuauaccggaugggguaagcucagcgccaagcugauaaacggcauccgggaugaaaaauccgggaauacaauucuagacuaccugaucgacgauggaauuucuaacagaaauuucaugcagcucauccacgacgaugcucugucguucaagaaaaagauacaaaaagcgcagauuaucggcgacgaggauaaggguaacaucaaagaagucguuaagagccuucccggguccccugcaauuaagaaaggcaucuugcagucaauuaagauaguggacgagcuggugaaagucaugggaggcaggaagccagaaaguaucgugguagagauggcccgcgagaaucaguauacuaaccaagggaaaucuaauagccagcagcgauuaaagcggcucgaaaagucccugaaagagcuuggaucaaagauucugaaagaaaacauccccgcuaaguugagcaaaauugauaauaacgcccuccagaaugaccgucuguaccuauauuaccugcaaaacgguaaggauauguauaccggcgacgaucucgacaucgacagacugucuaacuacgauauagaccauaucauuccucaggcauuucuuaaggauaauuccaucgacaacaaaguuuuggugaguagcgccucuaauagggggaaguccgaugacuucccaucacuggaggucgugaaaaagcgcaaaacauuuugguaccaguuacucaagaguaagcugauuagccagcggaaauucgauaaccuuacuaaggcugagagaggaggccugcuacccgaagacaaagccgguuuuauccaaaggcagcucgucgagacccgacagauaacaaagcacguggcacgccuguuggaugaaaaauucaauaacaagaaggacgagaauaaccgggcgguuagaaccgugaaaauuaucacucugaagucgacguuaguaucccaguuuaggaaagauuucgaacucuauaagguccgugagaucaaugacuuucaucacgcucaugaugccuaccugaacgcagugauugccucugcccuucugaaaaaguauccgaaauuggagccugaguucguuuacggggacuaucccaaguacaauagcuuucgcgaacggaagucagcuacagaaaaaguguauuucuacaguaacauaaugaauaucuucaagaaauccauuucucucgcagacggcagagucaucgagaggccacugauugaagugaacgaggagaccggagaaagcguauggaauaaggaguccgaucuagcuacugugcgacggguucugucauacccucaagucaacguggugaaaaaggucgaggaacagaaccacggccuugaccgcgggaagcccaaaggacucuuuaaugccaaccugagcaguaagccaaaacccaauucuaacgaaaauuugguuggugcgaaggaguaucuggauccuaaaaaguacggcggguaugccggaaucuccaacagcuucgcuguguuagugaagggcaccauagagaaaggugcaaagaaaaagaucacaaauguacucgaauuucaggggauuucgauccuggacagaauuaacuacaggaaagauaaacuuaauuuccuguuggagaagggcuauaaagacaucgaacucauaauugagcugccaaaguacucacuauuugagcugucugauggaagucggcgaaugcuugccuccauccucagcaccaacaauaaaagaggcgaaauccacaaggggaaccaaauuuuccugucucagaaauuugucaaguuguuauaucaugcuaaacgcaucagcaauacuauaaacgagaaucacaggaaguacguggaaaaccauaagaaagaguucgaggaacuguuuuacuauauucucgaguucaaugaaaacuacguuggagccaagaaaaacggcaagcugcuuaauuccgcauuucagucauggcagaaccacaguaucgacgagcuguguagcucuuucauugguccgacaggguccgaacguaaaggauuguuugagcuaacgucacggggcagugcggccgauuucgaguuccugggugugaagauccccagauauagggacuacaccccuagcucccuccugaaggaugcuacucuuauacaccaaucugucacaggcuuauaugaaacccgcauugaccuggccaaacucggggagggauga

SEQ ID NO: 2544 - RNA, 3306 nt, Artificial Sequence
  Cas9 variant
augugguacgccagccugauguccgcucaccaucucagagugggcaucgacgucgggacccacucuguuggacuugcaacacugaggguggaugaccaugguacucccauugaguuguuaucagcccugagucacauacaugauagcggcguagggaaggaaggaaagaaggaccacgauacgcggaaaaagcuauccggcaucgcgcgccgagcucguagacuccugcaccauaggcggacccagcuucaacagcuggacgagguguugcgcgaucucgguuucccuauuccaacaccgggggaauuucuggaccugaacgagcagacugaucccuauagagucuggagggugcgggcccgccucguugaagagaaauuaccugaggaacugcgaggaccagcaaucucuauggccgugagacacauugcuaggcaucggggcuggcguaaucccuacucgaaggucgagucacuuuugagcccugcagaagagaguccauucaugaaggcccugcgcgagagaauccuagcuaccacaggcgaagugcucgacgaugggauaacccccggacaggccauggcgcaaguagcacugacucacaacaucuccaugagggguccugagggcauucuugggaaacugcaccagucugacaaugccaacgaaauccggaagauuugcgcucgacagggaguuagcccagauguguguaaacaguugcuccgcgccgucuuuaaggcagacuccccgagaggcucagcugugaguaggguggcccccgacccucugccaggucaagggagcuuccggcgcgcgcccaaaugcgauccugaguuucagagauucaggaucauaucuauugucgccaauuuacguaucuccgaaacaaagggagagaaccggccacugaccgcagacgagcgaagacauguugugacguuucucacugaagauucacaggcugaccuuaccuggguagauguggccgagaagcugggcguccacaggcgcgacuugcggggcacagcugugcauacugaugacggggaaagaagcgccgcaaggcccccgauugaugccaccgaccgcaucaugcgacagacaaaaaucaguucucuaaagaccuggugggaggaagcugauuccgagcaacggggagcgaugauucguuaucuguacgaggacccuacggacagcgaaugugcagagauaaucgccgaacuccccgaggaagaucaggcuaaacuggacucgcuucaucugccagccgguagagcagccuauucuagggaguccuugacugcucucucagaucacaugcuggccacaaccgacgauuuacacgaggcacgcaagcggcuguucggcguugacgauaguugggcgccucccgcugaagccauuaaugcaccaguggggaaccccagcgucgacagaacucuaaaaaucgugggaagguaccucuccgccguagagucuauguggggcacaccugaaguuauacacguggagcauguccgagaugguuuuaccagcgagcgcauggcugacgaacgggauaaggccaauagaaggcguuauaacgacaaucaggaggcaaugaaaaagauucaacgcgauuacgggaaggaaggcuacaucucacggggagacaucgugagacuggacgcucuugaguugcagggcugcgccugucuguauugcgggacgaccauuggauaccacacaugucagcucgaucauaucgucccacaggcggguccgggcaguaacaauaggcgagggaaccugguggccguuugcgaacgguguaaucgcuccaaaagcaacacucccuucgcugugugggcacaaaagugcggcauuccucacguaggagucaaagaggccauagguagagugaggggguggcggaagcagaccccaaacacaucuucagaggaccuuacucgacugaaaaaggaaguuaucgcuagauugcgcaggacccaggaggaucccgaaauugacgagcguaguauggaaagcguggccuggauggcaaaugagcuccaccaucggaucgcggccgcuuauccugagacaaccgucaugguguacagaggcuccaucacugccgcagcuaggaaggccgcaggaauugauucucgcauaaaccugaucggcgaaaaagggcgaaaggacagaauugaucggaggcaccaugccguagacgcuucggugguugcguuaauggaggccagcgucgcaaaaacgcuggcugaacgcuccucacuacguggagagcagagacucacagguaaggaacaaaccuggaaacaguauacuggcaguaccgugggggcccgggagcacuuugagauguggaggggacauaugcugcaccuuacagaauuguucaaugagcgccuggccgaagauaagguguacgucacccagaacauccgacucagacugucugacggcaaugcucacacuguuaacccaagcaaguuagugucccaucggcugggugaugggcuuacagugcagcaaauugacagggcauguacgcccgccuuguggugcgcgcucacccgcgagaaagauuuugacgagaagaauggccugccggcuagagaagacagggccauccggguacacggacaugagauaaaaucaagcgauuauauccaggucuucucuaagcguaaaaagacugacuccgaucgcgacgaaacaccuuucggcgcaauugccgugcgagggggauuuguugagaucggcccaaguauucaccaugcuagaaucuacaggguggaagguaagaaacccgucuacgcaaugcuacggguguucacccacgaucugcucagccagcgccacggggaccuguuuucugccguuauaccuccccaguccauuucaaugagaugcgcggagccaaaacuuaggaaagcuaucacaacuggaaacgccaccuauuugggcugggugguagucggugaugagcuggaaauuaauguggacaguuucacgaaguacgcaaucggccgguuuuuagaggauuucccuaacaccacacgauggagaauauguggguaugacacuaauagcaaacucacccugaagcccaucgugcuugccgcugaaggacuggagaacccaucguccgccgucaaugaaauuguugaguugaaaggcuggcgcguggcaaucaacguacucacaaaggugcauccgacugucgugaggcgggaugcucuggggcguccuagauacucuagcaggucaaaucuacccaccaguuggacgauugaguga

SEQ ID NO: 2545 - RNA, 4167 nt, Artificial Sequence
  Cas9 variant
augaccaagcccuacagcaucggccuggacauugggacaaacuccgugggaugggccgucacuacggauaauuauaaaguuccuucuaagaaaaugaaggugcucgguaacaccucaaagaaguacauaaagaaaaaucuucugggcguauuguuauucgacagugggaucacagcugagggaagaaggcugaagcggacugcacgccgacguuauaccagaaggcggaaccgcauucuauaccuccaggaaaucuuuagcacagagauggccacccuggaugacgcguucuuucaaagacuugaugacuccuuccuggugccagaugacaaaagggauucuaaguauccgauuuuuggcaauuuggucgaagagaaggcuuaccacgacgaguuccccacuaucuaucaucuccggaaguaccuggccgauucgacaaagaaagcagaccugcgccucguguacuuagcccuggcucacaugauaaaguaucgaggucauuuucuuaucgagggggaguucaacucaaagaauaacgauauucagaagaauuuucaggacuucuuggacaccuacaacgcaaucuuugaaagcgaucugagucuagaaaauuccaaacagcucgaagagauuguuaaggacaaaaucucuaagcuggagaagaaagauagaauacuuaagcuguucccuggagaaaagaacagcggcaucuuuuccgaguucuugaagcucauugugggcaaucaagccgacuucaggaaaugcuuuaaccuggaugaaaaggcuucauuacacuucaguaaggagagcuaugacgaagaucuggagacgcuccuuggguacauuggagacgauuauucugacgucuuucugaaagccaagaaauuguacgaugcgauccuacuguccgguuuccucacugugaccgacaaugagacagaagcaccacugucaagcgccaugaucaagcgguauaacgagcauaaagaagaccuugcucuguugaaggaguacauucguaacauaagucucaagacuuacaaugaaguauuuaaagaugacaccaagaacggcuaugccggguacaucgauggaaaaacaaaucaggaggacuucuauguuuaccugaagaaauuacuggcagaguuugaaggcgcugauuauuuccuagagaagauugaccgcgaagauuuucucagaaagcagaggaccuucgacaacgguucuauccccuaccagauacaucugcaagagaugcgggccauucuugauaaacaggcgaaguuuuauccuuucuuggccaaaaauaaggaacgaaucgagaaaauccugacguuucgcauuccauacuacguggggccccucgcaagaggaaacuccgacuucgcuuggagcaucaggaagcggaaugagaaaauuacuccuuggaacuucgaagaugucauagacaaggagucgucugccgaggcuuuuaucaaucgcaugacauccuucgaucuguaucuuccagaagagaaggugcugccgaaacacucauugcucuacgaaaccuuuaacguguauaaugagcugacuaaggucagauucauugccgaaaguaugagggacuaccaguuuuuagacagcaaacagaagaaagauaucguucgucuguauuucaaggacaagcggaaagugacagauaaggacaucauugaguaccuacacgcaauauauggcuacgauggcaucgaacucaaagggauugagaagcaauuuaacuccucucugagcaccuaccacgaccuuuugaauaucauuaacgauaaagaguuccuggacgauucaaguaaugaagccaucauagaggaaaucauucauacgcucaccaucuuugaggaccgagaaaugauuaagcagagacuguccaaguucgagaacaucuuugauaaaagcguauuaaagaaacugucuaggcgccacuauacaggaugggguaaacuuucagcuaaauugauaaacggcauucgggacgagaagagugggaauacuauccucgauuaccugauugacgacggaaucagcaacagaaauuucaugcagcuaauacacgaugacgcgcuguccuuuaagaaaaagauccaaaaagcacagauuaucggcgaugaagacaaggguaacauuaaagagguggucaagucucuccccgggucgccugccaucaaaaagggcauacugcagagcauuaagaucguggaugaacuuguuaaagugaugggaggcaggaagccagaguccaucgucguggaaauggcucgcgagaaucaguauaccaaccaagggaaaucaaauagucagcagcgauugaagcggcuggagaaaucuuuaaaggaacucggaagcaagauucugaaagagaacauccccgccaaacuuuccaaaauugacaauaacgcacugcagaaugaucguuuguaccucuauuaccugcaaaacgguaaggacauguauacaggcgaugaccuagauauagacagacugucaaauuacgacaucgaucauauuaucccucaggccuuccucaaagacaacagcauugauaauaagguacugguuucuuccgcuaguaacaggggaaagagcgacgaugugccaucucuugaagucgugaaaaagcgcaaaacuuucugguaccaguugcugaaguccaaauuaaucucacagcggaaguuugacaaccucaccaaggccgagagagggggccugagucccgaggauaaagcagguuucauacaaaggcagcuugucgaaacacgacagaucaccaagcacguggcgcgccugcuagacgagaaauuuaauaacaagaaagaugaaaauaaccgggcuguuagaacugugaagauuaucacgcucaagagcacacugguaucgcaguucaggaaagacuuugaguuguauaagguccgugaaauuaaugauuuccaucacgcccaugacgcauaccugaacgccgugguugcuuccgccuuacucaaaaaguauccgaaacuggagccugaguuuguguacggggauuaucccaaguacaauucuuuccgcgaacggaaaagcgcaaccgagaaggucuauuuuuacucaaacaucaugaauauauucaagaaaaguauuucccuugcugacggcagagugaucgaaaggccacugaucgagguaaacgaagagacuggagagucuguguggaauaaggaaagcgacuuggccaccguucgacggguccucuccuacccucaagugaacguggucaaaaagguugaggaacagaaucacggccuggaucgcgggaaacccaagggacuauuuaacgcgaaucugucaagcaagccaaaacccaacaguaacgagaaucuugugggugccaaggaauaucucgacccuaaaaaguacggcggguaugcuggaauuucuaacuccuucacagugcugguaaaaggcaccauagagaagggugcaaagaaaaagaucacuaaugucuuggaguuccaggggauuagcauccuggauagaauuaacuacaggaaagacaaguuaaauuuucuccuggaaaaaggcuauaaggauaucgagcuuauaaucgaacugccaaaguacucguuguucgagcucucagacggaucucggcgaaugcuggccaguauucuauccacaaacaauaaaagaggcgagauccacaaggggaaccaaauuuuucugagccagaaauucgugaaacuucucuaucaugcuaaacgcaucucuaauacgauaaacgaaaaucacaggaaguacguugagaaccauaaaaaggaauuugaggaacuguucuacuauauuuuggaguuuaaugagaacuacgugggagccaagaaaaauggcaaguuacugaacagcgcauuccaguccuggcagaaucacucaaucgaugaacucuguaguagcuuuaucgguccgaccgggucugagcguaaaggacuguucgaacuuacuucccggggcucagcggccgacuuugaguuccugggugucaagauucccagauauagggauuacacaccuaguagcuugcuaaaagacgcuacccugauccaccaauccgugacaggccucuaugaaacucgcauagaucuggccaaacuuggggagggauga

SEQ ID NO: 2546 - RNA, 3249 nt, Artificial Sequence
  Cas9 variant
auggccgcuuucaagcccaacagcaucaauuacauucugggccucgacauagggaucgcauccgugggaugggccauggucgagauugaugaagaggaaaacccuaucagacuuauugaccuggguguuaggguguuugagcgggcggaaguaccaaaaaccggcgauucuuuggcuauggcccgccgauuagcacguucagugagaaggcugacacggcgcagagcccacaggcuacuccggacucgccgacugcuuaagagagaggggguccugcaggcugcaaauuucgacgagaacggauugaucaaaagucucccgaauacgcccuggcaacugagggccgcugcccuggaucggaagcucaccccuuuagaauggagcgcggugcugcuucauuugauaaaacaccguggcuaucugucccagcgcaagaacgagggugaaacagcagacaaggagcuaggggcccuccugaaaggaguugcuggcaaugcccaugcacuucagacuggcgauuuuagaaccccagcugagcuggccuugaacaaguucgaaaaagagucugggcacaucaggaaucagcggucggacuacucacauacauuuagccgaaaggaucuccaagcggaacugauuuuacuguucgagaaacagaaggaauuuggaaacccccacgugagugguggccucaaggaggggaucgagacccuucugaugacucagcgcccugccuuguccggagacgcaguccagaaaaugcuaggccacugcacauucgaaccagcugagcccaaggccgcuaaaaauaccuauacggccgaaagauuuauuuggcugacuaagcucaacaaucugaggauccuugagcaagguucugaacggccucugaccgauacagagcgcgcaacuuugauggacgagccauacagaaaaagcaagcucaccuaugcccaggcuaggaaacuguuagggcuggaagauacagcguucuuuaagggacuacguuacggcaaggacaacgcagaggccuccacccucauggaaaugaaggcuuaucaugccauaucacgggcacuggagaaagaaggccuuaaagacaagaaaaguccguugaaucugagccccgagcuccaggaugagauugggacggccuucucucuguuuaagacugacgaagauaucacaggacgacuuaaggacaggauucagccugagauccuggaggcuuugcucaaacacaucuccuucgauaaguucgugcaaauuucacugaaagccuuaagacgcauaguaccacugauggaacaggguaagcgguacgacgaggcaugugcggaaaucuacggcgaucauuaugggaaaaagaacaccgaggaaaagauuuaccuacccccuaucccagcugacgagauaagaaaccccguugugcucagggcccugagccaggcacgcaaagucauuaauggaguggugcgacgguauggcaguccggcccguauccacaucgaaacugcuagagaggucgguaagucuuuuaaagauaggaaggagauugaaaaacgccaagaggaaaaccggaaggacagagagaaggccgcagcuaaauucagggaauacuuuccuaauuucguuggggagcccaaguccaaagauauccuuaaguugcgacuguaugagcagcagcacggcaaaugccucuacagcggaaaggaaauuaaccugggccgcuuaaaugagaaaggguauguggaaauagaccaugcccugccauuuucgcggacaugggacgauucuuucaacaauaagguacuuguguugggauccgagaaccagaauaaggguaaccaaaccccuuacgaauacuuuaauggcaaagacaacucaagagaguggcaggaguucaaggcgagggucgaaacgagucguuuuccccgcagcaaaaagcagcggauccuccugcagaaauucgaugaggacggguuuaaggaaagaaaucuaaacgauaccagguaugugaaucgauuccugugucaauuuguugccgaccggaugcgccucacaggaaagggcaaaaagagaguguucgcuuccaacggucagauuacuaaccugcuuaggggguucuggggcuugcggaaaguccgagcagagaaugauagacaccaugcccuggacgcugugguaguugccugcucuaccguggcaaugcagcagaagaucacacgcuuugucagguacaaagagaugaacgcguucgauggaaagacuaucgacaaggaaaccggcgagguguuacaccagaaaacacauuuuccacagcccugggaguucuuugcccaggaagucaugauucguguguucgggaagccugauggaaaaccagaauuugaggaggcugacacccucgaaaagcugcggacucuucuggccgagaaauugagcucaagaccggaagcaguucacgaguaugugacgccccucuucguaaguagggcuccuaaucgcaagauguccggucagggccacauggaaacagucaagagcgccaaacgacuggaugagggggugucuguucuaagagugccacugacccaacucaagcugaaagaccuugagaagauggucaaccgggaaagggagcccaaauuguacgaagcacugaaggcccgcuuagaggcucauaaagacgauccugcgaaggccuuugcagaaccauucuauaaguacgacaaagcuggaaaucguacucaacaggugaaggccguaagaguggagcaaguucagaaaaccggcgucugggugcggaaccacaaugguauagccgauaacgcuacaauggugagggucgacguuuuugagaagggggauaaauauuaccucgugcccaucuacucauggcaaguggcaaagggcauucugccggaccgcgccguaguccagggaaaggaugaagaggacuggcagcuuaucgaugacaguuucaauuuuaaauucagccugcauccuaacgaucuaguggaaguuauuaccaagaaagcgcgaauguucggcuauuuugcuuccugucacagagggacuggaaauaucaacauacggauccacgaccucgaucauaagauuggcaaaaaugguauccuggaggggauuggagugaagacagccuugucuuuccagaaguaccagaucgacgagcugggcaaagaaauaaggccaugccgcuuaaagaaaagacccccugucagguga

SEQ ID NO: 2547 - RNA, 4005 nt, Artificial Sequence
  Cas9 variant
augaagaaacccuacaccaucggccuggacauugggacaaacagcgugggaugggccguccucacugaucaguaugaccuuguuaagagaaaaaugaagauagcuggugauuccgagaaaaagcaaaucaagaaaaauuucuggggcgugaggcuguuugacgaagggcagacggcagccgaucggcgcauggcgcgaaccgcucguagaaggauugagcggcgcagaaacaggaucucuuacuugcagggaauuuucgccgaagagaugucaaagacagacgcaaacuuuuucugccgguuaagugauagcuuuuauguagacaacgaaaaacgcaauucccgacacccuuucuuugccacuaucgaggaggaaguggaguaccauaagaacuauccaaccauauaccaccugagagaggagcuagucaauucuucggagaaagcugaucucaggcugguguaucuugcacuggcccauaucauuaaguaccggggcaacuucuugaucgaaggugcucucgacacacagaauaccucaguugaugggauuuacaagcaauuuauccagacuuauaaccagguguucgccagcggaauagaggacggcagucugaaaaagcuggaagauaauaaagacgucgcgaagauucucguggagaaaguaacacguaaggaaaaauuagagcgcauccugaaacuuuacccgggcgagaaguccgcagggauguuugcccaguucauuucuuugaucguuggaagcaaagguaacuuucaaaagcccuucgaccugaucgaaaaauccgauauugagugugcuaaggacucauaugaagaggaucuagaaagucuccuggcccuuauaggcgacgaguacgcagagcuguucguggcugccaaaaaugcguauagcgccgucguguugucuuccaucauuaccguggcagaaacggagacuaacgcuaagcucucagccagcaugaucgaaagauuugauacccacgaggaagaccugggggaguuaaaggcuuucauaaaacugcaucucccuaagcacuacgaggaaauuuuuaguaauacagagaaacacggauaugccggcuacaucgaugguaagacuaaacaggcagacuucuacaaguauaugaagaugacccuugaaaacaucgagggggccgauuacuuuauugcuaaaaucgagaaggaaaacuuccugaggaaacagcggacauuugacaauggagcgauuccacaucaguugcaccuagaggaacuggaggcaauacuccaucaacaggccaaguauuaccccuuccugaaagaaaacuaugauaagaucaagucucuugucaccuuucgcauuccuuacuucguuggcccacuggcuaauggccaguccgaauuugccugguugacgcgaaaggcagacggggagaucagacccuggaauaucgaagagaagguggacuucggaaaaagcgccguagauuuuauugaaaagaugacuaauaaagacacauaucucccuaaggagaacgugcugccaaaacacucguuaugcuaccaaaaguaccuggucuauaaugaacuaaccaaggugagguacauaaacgaucaggguaaaacuucuuauuucuccggccaggagaaggagcagaucuucaaugaccucuuuaaacaaaagcggaaaguuaagaagaaagaucuggaacuuuucuugcgcaacaugucacacguggagaguccgacaauugaagggcuggaggacagcuuuaauuccucuuacagcaccuaucaugaucuccugaaggucggaaucaaacaggaaauucuugacaaccccgugaauacggagaugcuggagaacaucguaaagauauugaccguuuucgaagauaaaagaaugaucaaggagcagcuccagcaauuuucagacgugcuggauggcgucguguuaaagaaacuggaaaggcgucacuacacagguugggggcggcuaagugcuaagcuccugaugggcauucgagacaaacagucccaucuuacuaucuuggauuaucugaugaaugacgacggacucaacagaaaccugaugcaguuaauuaaugauagcaaccugucuuucaagucaaucauagagaaagagcaggucaccacagccgacaaggauauucaaaguaucguggcagaccuugcgggcagcccugcuauuaagaaagggaucuugcagucccucaagauaguugaugaacuggugucuguaaugggauacccaccccagacuaucgucguggagauggccagggaaaaucagaccacagguaaaggcaagaacaauucgcgcccucgguacaaaagccuagagaaggcaauuaaagaauuugggucccaaauccugaaggagcacccaaccgacaaccaggagcucagaaauaacaggcuguaucuuuacuauuugcagaauggaaaggauauguacacuggccaagaccuggauauucauaacuuaucaaauuaugacaucgaucacauaguuccccagaguuucauuacggacaacucuaucgauaaucucgugcugacaagcuccgccgguaaccgcgaaaaaggggacgacgucccgccucuugagaucgugcgaaagcggaaaguauuuugggaaaagcuguaccagggcaauuugaugucaaaacguaaguucgauuaucucaccaaggcugagagaggaggccugacugaagccgacaaagcaagguuuauucaccgccagcuaguggagacccggcaaaucacaaagaacguugcuaacauucugcaucagagauucaauuacgagaaagaugaccacgggaacaccaugaagcaggucaggauagugacucucaaaagcgcccuggugucucaguuucgaaagcaauuccagcuuuacaagguccgcgauguuaaugacuaucaucacgcgcacgaugccuacuugaacggagugguggcuaauacacuguuaaaaguauauccccagcucgaaccagaguucgucuacggugacuaucaucaguuugauugguucaaggcaaacaaagccacggcuaagaaacaauuuuacaccaauaucaugcuguucuuugcccagaaggaccggauuaucgaugaaaacggcgagauucuuugggacaagaaauaucuggacacugugaagaaaguuauguccuacagacagaugaauaucgugaagaaaacagaaauacaaaagggggaguucaguaaggcaaccaucaaaccuaagggaaacagcucuaaacuaauucccaggaagacaaauugggauccaaugaaauacggcggucucgacucccccaacauggcguaugccgucgugaucgaguacgcuaaggggaaaaauaagcugguuuuugaaaagaaaauuauccgugugacuauaauggagcgcaaggccuucgaaaaagaugagaaggcauuuuuggaggaacagggcuaucggcagccuaaaguacuggcuaaguuaccaaaguacacccucuaugagugugaagagggaagaaggcgaaugcuggccucagcaaacgaagcccagaaaggcaaucaacagguccuuccgaaccaccuggugacguugcuccaucacgcugcgaacugcgaggugagugacggaaagagccuggauuacauugagucgaaucgggaaauguucgccgagcuacuggcacaugucuccgaauuugcuaaacgcuauacccuugccgaggccaaccucaauaagaucaaccagcuguucgaacagaauaaagagggggacaucaaggcuauugcacaaucuuucguugauuugauggccuuuaacgcgaugggcgcucccgccagcuucaaguuuuucgagacaacuauagaaagaaaaagguacaauaaccugaaggaguuacucaauucaaccaucauuuaccagaguaucacaggucuguaugaaucccggaaacgacuugacgauuga

SEQ ID NO: 2548 - RNA, 4038 nt, Artificial Sequence
  Cas9 variant
augaagaaacccuacagcaucggccuggacauugggaccaacuccgugggaugggccgucguuacagaugacuauaaggugccugcuaaaaagaugaaaguacucgguaauacugauaagucucacauagagaagaaccuucugggcgcauuguuauucgacucagggaauacggccgaagauagaaggcugaaacggaccgcgcgccgacguuacacaagaaggcggaaccgcauccuauaucuccaggagauuuuuagugaagagaugggaaagguggacgauagcuucuuucauagacuggaagacuccuuccuugucacugaggauaaaaggggcgagcggcacccaaucuuugguaaucuggaagaggaagugaaguaccaugagaacuucccgaccauuuaucacuugcgccaauaccucgcugacaaucccgagaaaguugaucugcgacugguguaucucgccuuagcacauaucauaaaguuuagagggcacuuccugaucgaaggaaaguuugacacaaggaacaaugauguccagcggcuuuuccaggaguuuuuggccguguacgacaacaccuucgaaaauucuucgcugcaggagcaaaacguacagguugaagagauucuaacugacaaaaucucaaagagcgcuaaaaaggaucgugugcucaaacuguuuccuaaugagaagaguaacggccgcuucgcagaguuccuuaaacugauugucggcaaucaggccgacuuuaagaagcacuucgaguuggaagagaaagcuccacuccaguuuuccaaggauacauacgaagaggagcuggaaguguuacuggcccaaaucggggacaacuaugcggaacucuuccuuucugccaaaaagcuguacgauagcauauugcuauccgguauucugaccgugacggacgucggaacuaaagcaccccucucagcuaguaugauccagagauauaacgaacaucagauggaucuggcccagcuuaagcaauuuauuaggcagaagcugagcgacaaauacaaugagguuuucucugauguguccaaggacggcuaugcaggguacaucgauggaaaaaccaaccaggaagcauuuuauaaguacuugaaaggccuccugaauaagaucgaggguucaggguacuucuuagacaagauugagcgggaagacuuucugcgaaaacaacgcacauucgauaacggaagcauaccucaccagauccaucuacaggagaugagagccauuaucaggcggcaggcggaauuuuauccauuccucgccgacaaucaagaucgcauagagaagcugcuuacuuuuaggauucccuacuauguaggcccuuuggcaagaggcaaaagugacuucgcuuggcugucucguaaguccgccgauaaaaucaccccauggaacuucgacgagaucguggauaaggaaagcucggcugaggccuuuauuaaucggaugacaaacuacgaccucuaucugccgaaucagaagguccuucccaaacacucucuguuguacgaaaaguucaccguguauaacgagcucacgaaaguuaaguacaaaacugaacaggggaagacagcauuuuucgaugccaauaugaaacaggagaucuuugacggaguguucaaggucuaccgaaaggugaccaaagauaagcugauggacuuuuuagagaaagaguucgaugaauuuagaauuguagaccugacuggucuagacaaggaaaacaaaguuuucaaugcuuccuauggcacauaccacgaucucugcaagauacuggacaaggauuuucuugacaacaguaaaaaugagaagaucuuggaagauauugugcugacccucacgcuguucgaggacagggagaugauccgcaaacgguuagaaaacuauucagaucugcuuaccaaggagcaagucaaaaaguuggaaagaaggcauuacacaggguggggacgccucagcgcggagcugauccacggcauucgaaacaaggaaucccggaaaacuauacuagacuaucugaucgaugacgguaauucuaaccguaauuuuaugcagcucauuaacgaugacgcacugagcuucaaggaggagaucgccaaagcucaggugauuggggaaaccgauaaucuuaaccaggucgugucagacaucgccggcaguccugcaauaaagaaaggaaucuugcaaucccugaagauuguugacgaguuagugaagaucaugggccaucagccagaaaauauuguagucgagauggccagagagaaccaguucacaaaucaggggaggcgcaacagccaacagcggcucaaaggacugacugauucuaucaaggaauuugguucacagauacuuaaagagcaccccguggaaaauagucaacugcagaacgacagauuguuccucuacuaucugcagaauggcagggauauguacaccggggaggaacuagacauugauuaccugagccaguaugacaucgaucauauuaucccucaggcuuuuauaaaggacaacuccaucgauaaucgaguucucacaucuucgaaagagaaccgcggaaagagcgacgaugugccauccaaagacgucgugcggaagaugaagucauacuggaguaaacugcuuucugccaaguugauuacccaaagaaaauucgacaaccugacuaaggcagagaggggcgguuuaacggaugacgauaaagcgggguuuaucaagcgucagcucguagaaacacgccagauuaccaagcacguggcucggauccuggacgagagauucaauacugaaaccgaugagaacaauaaaaagauaaggcaaguuaaaauugucacacuuaagagcaaccugguguccaauuuucgaaaagaguucgaacuauauaaggugcgggagaucaacgacuaccaccaugcccacgaugcauaucucaaugccgucaucggcaaggcucuguugggaguuuacccccagcuggaaccggaguuuguguauggcgacuacccucauuuccacgggcacaaagaaaacaaggccaccgcuaaaaaguuuuucuacucaaauauuaugaacuucuuuaaaaaggaugacgugcgcacugauaagaauggagagaucauuuggaaaaaggacgaacauauaagcaacaucaaaaagguauuaucuuauccccaggucaauauugugaaaaagguugaggagcagacagguggcuucuccaaggaaaguauccucccaaaagggaacagcgauaagcugauuccuagaaaaacgaagaaauuuuacugggacaccaagaaauauggaggcuucgacucucccaucguggcuuacuccauacuugucaucgccgauauugagaaggguaagaguaaaaagcugaaaacugugaaggcguugguuggggugacaaucauggagaaaaugaccuuugaaagggacccaguagccuuccucgagcggaagggcuaucgaaauguccaagaagagaacauuaucaagcugcccaaauacucacuauuuaagcuggaaaacggaagaaaacgccuucucgcuagcgcaagggagcugcagaagggcaaugaaauaguguugccuaaccaccuggggacauuacucuaucaugccaaaaauauucacaagguggaugagccaaagcaucuggacuacgucgauaaacacaaggacgaguucaaagaacuucuggauguugugucgaacuuuuccaagaaauacacuuuggcugagggaaaucucgaaaagaucaaggagcuguaugcccagaacaauggcgaagaccuaaaagagcuggcaucuagcuucaucaaccuucucaccuuuacggcgauuggugccccggcuaccuucaaguuuuucgauaaaaauauagaccguaagcgguacacaucaacuaccgagauccugaacgccacauugauucaccaaaguaucacuggguuauaugaaaccagaauugaucugaauaaacucggaggcgacuga

SEQ ID NO: 2549 - RNA, 3171 nt, Artificial Sequence
  Cas9 variant
augcagaccacaaaccugagcuacauccucggccuugaccuggggauugccuccgugggaugggcugucguugagauaaaugaaaacgaggaucccaucgguuugauugacgugggcguaagaaucuucgaaagggcagaggugccuaagacuggggaaucuuuagcccugucacggcgccuagcgcgaaguacgcguagacucauuaggcggcgcgcucacagacugcuucuggccaaaagguuuuugaagcgggagggaauccucagcaccauagaucuggagaaaggccugccaaaucaagcaugggaacuccgcgucgccgguuuagagcgaagacuguccgcuaucgaauggggagcagugcuuuugcaucugauuaagcacaggggguaucuaucuaaacggaagaacgagucgcagacaaauaacaaggagcucggcgcccugcuuucaggcguugcucagaaucaucagcuguugcaaagcgacgauuaccguacuccggccgaacucgcgcugaaaaaguucgcaaaagaggaagggcacauccgcaaccagagaggagccuauacccauacauuuaauagguuagaccugcucgcugagcuuaaccuguuguucgcccagcagcaccaauuugguaauccccacugcaaggaacauauucagcaguacaugaccgagcuacugauguggcagaaaccugcacucaguggcgaggcuauccugaagaugcuugggaaguguacucacgaaaagaacgaguucaaggccgcgaaacauacauauuccgccgaacgguuuguguggcugaccaaguugaauaaccuccgaauacuggaggauggagcagaacgcgcuuuaaaugaggaggaaagacaacugcuaauuaaccacccauacgagaaaucuaagcucacguaugcccaggucaggaaacugcuuggcuugagcgaacaggcuaucuucaagcaccuccgguacuccaaggagaacgccgaaucagcaacuuuuauggagcucaaagccuggcaugcuauucgcaaggcgcuggagaaucaaggucuuaaagacaccuggcaggaucuggcaaagaaacccgacuugcucgaugaaaucgggacagccuucagucuguacaagacugacgaggauauccagcaguauuuaaccaacaaggugccuaauagcguaauuaacgcucugcuaguuucucucaauuuugacaaauucauagaacugucccuuaagucauugagaaaaauccugccacucauggagcaaggaaagagguacgaccaggccugccgugagauuuauggccaccauuacggcgaagcaaaccagaaaacaagccagcuguuacccgccaucccugcucaagagauacggaauccagugguccugcgaacccuuagucaggccagaaaggugauuaacgcaaucaucaggcaguaugggucuccggcgcgcgugcacauugaaacgggacgggaguuggguaaguccuuuaaagaaagaagggagauccagaagcaacaggaggauaaucgcacuaaacgagaaagcgcuguccagaaguucaaagagcuguucucggacuuuucuuccgaacccaagucaaaggauauucugaaauuccggcuauacgagcagcaacauggcaagugucuguauagugggaaagaaauaaacauccaccgucucaaugagaagggauacguugagauugaccacgcccugccuuuuagcagaacaugggaugacuccuucaacaauaaagugcuuguauuggcaucugaaaaccagaauaagggcaaccagaccccauacgaguggcugcaagguaaaaucaacagcgaaagguggaagaauuuuguggccuuaguccucgggucacagugcagugcugccaagaaacagcgccugcuuacucaggugaucgaugacaacaaguucauugaucggaaucugaacgacacaagauauauagcaagguuuuuguccaauuacauccaagagaaccuccugcuaguuggcaaaaauaagaaaaacguguucacccccaauggacagauuacggcucugcuccgaagccgcuggggccugaucaaggcccgggaaaacaauaacagacaucacgcgcuugaugccauugucguggcuugugcaaccccuucuaugcagcagaagaucacaagguuuauacguuucaaagagguacauccauauaagaucgagaaucgcuacgaaaugguugaccaagagucaggggaaauuaucaguccccacuuuccggagccuugggccuauuuccggcaggaggugaacauuagagucuuugacaaucaccccgauacuguguugaaagaaaugcugccagacaggccucaggcuaaccaucaguucguccaacccuuauucgugagccgagccccaacccggaagauguccggacagggucacauggagacaaucaaaucugcaaagcgccucgcggaaggcauaucgguucugaggauuccccuuacucagcugaagccuaaccuacucgagaauauggugaacaaagaaagagagccagcccuguacgcuggguugaaggcccggcuggcagaguuuaaucaagauccggcuaaagccuucgcaacccccuuuuauaagcagggaggccagcagguaaaagccauccgagucgaacaagugcagaaaagcgguguuuuagugagagagaacaauggggucgcugacaacgcguccauugugcgcacagauguauucaucaagaauaacaaauuuuuccucgugccuauauacaccuggcagguugccaagggcauccugccaaauaaagcaauugucgcucauaagaacgaagacgagugggaagagauggaugagggagccaaauuuaaguucucacuuuuucccaaugaccugguggaauugaaaacuaagaaggaguacuucuuuggcuauuacaucgggcucgauagggccacgggaaacauuagucugaaagaacacgacggugagaucucuaagggcaaagaugggguguaucgugucggaguuaagcuagcucugagcuucgaaaaauaccagguggacgagcuuggcaagaaucggcaaauaugcagaccucagcagaggcagccagugcgcuga

SEQ ID NO: 2550 - RNA, 3249 nt, Artificial Sequence
  Cas9 variant
auggccgcuuucaagcccaacccuaucaauuacauucugggccucgacauagggaucgcaagcgugggaugggccauggucgagauugaugaagacgagaacccaaucugccuuauugaucuggguguuagaguguuugaaagggcggagguaccgaaaaccggcgacuccuuggcuauggcccggcgcuuagcacgaucugugcguagacugacaaggcggcgcgcccacagacuacucagggcucggcgccugcuuaagcgagaagggguccugcaggcagccgauuucgacgagaauggauugaucaaaucacuccccaacacuccuuggcaacugagagcugccgcgcuggauaggaagcucacgccauuagaguggagugcagugcugcuucauuugauaaaacaccggggcuaucugagccagcguaagaaugaaggugagaccgccgacaaggaacuaggggcucuccugaaaggaguugccgauaacgcacaugcccuucagacaggcgacuuucgcacucccgcugagcuggcguugaauaaguucgagaaagaauccggccacaucagaaaccagcgaggggauuacucucauaccuuuucgcggaaggaccuccaagccgagcugauuuuacuguucgaaaaacagaaggaguuuggaaauccucacgugucagguggccucaaggaagggaucgagacacuucugaugacccagcgaccagcauugagcggagaugcuguccagaaaaugcuaggccacuguacuuucgagcccgccgaaccuaaggcugccaaaaacacauauaccgcagagcgcuuuauuuggcugacgaagcucaauaaccugagaauccuugaacaagguagugagaggccacugacugacaccgaacgggccacauugauggacgagccguaccgcaaauccaagcucacuuaugcucaggcgagaaaacuguuagggcuggaggauaccgcauucuuuaagggacuaagguacggcaaggacaaugccgaggcuucuacacucauggaaaugaaagccuaucaugcaauaagccgugcccuggaaaaggagggccuuaaagauaagaaaucccccuugaaccugucaccugaacuccaggacgagauugggaccgcuuucagucuguuuaagacggaugaggacaucacuggacggcuuaaggauaggauucagccagaaauccuggaggccuugcucaaacacaucagcuucgacaaguucgugcaaauuucucugaaagcauuaagaaggauaguaccccugauggaacaggguaagcgcuacgaugaggcgugcgcugagaucuacggcgaccauuaugggaaaaagaauacagaagagaagauuuaccuaccuccaauccccgccgaugaaauacggaacccgguugugcucagagcacugucccaggccaggaaagucauuaacggaguggugcgccgauauggcucacccgcucggauccacaucgagaccgcccgugaagucgguaagagcuuuaaagacagaaaggagauugagaaaaggcaagaagagaaucgcaaggaccgggaaaaggcagcugccaaauucagagaguacuuucccaacuucguuggggaaccaaagaguaaagauauccuuaaguugaggcuguaugagcagcagcacggcaaaugucucuacucuggaaaggagauuaaucugggccgauuaaacgaaaaaggguauguggagauagaccaugcgcugccuuuuucccgcacuugggaugacagcuucaauaacaagguacuuguguugggaucggaaaaucagaacaaggguaaucaaacacccuacgaguacuuuaacggcaaagauaauucucgggaauggcaggaguucaaggccagagucgagaccuccagguuuccacguaguaaaaagcagcgcauccuccugcagaaauucgacgaagauggguuuaaggagcggaaccuaaaugacacgagauaugugaacagguuccugugccaauuuguugcugaucgaaugcggcucaccggaaagggcaaaaagcgcguguucgcaucaaauggucagauuacaaaccugcuuagaggguucuggggcuugaggaaaguccgggccgaaaacgaccgacaccaugcucuggaugccgugguaguugcauguagcacuguggcgaugcagcagaagaucaccagauuuguccgcuacaaagagaugaaugccuucgacggaaagacaaucgauaaggagacuggcgaaguguuacaccagaaaacccauuuuccccagccuugggaguucuuugcucaggaagucaugauuaggguguucgggaagccagacggaaaaccggaguuugaagaggccgacacacccgagaagcuccguacccugcuugcagaaaaacuguccucucggccugaggcuguucacgaauaugugacuccauuguucguaagcagagcccccaacaggaagaugucaggucagggccacauggagacggucaagagugcaaaacgccucgaugaagggguguccguucugcgagugccucuaacacaacugaagcucaaagaccuggagaagauggucaauagagagcgggaaccaaaacuuuacgaggccuugaaggcuaggcuggaagcgcauaaagaugaccccgccaaggcauuugcugagccguucuauaaguacgauaaagccggaaaccgcacccaacaggugaaggccguacguguggaacaaguucagaaaacuggcgucugggugagaaaucacaacgguauagcugacaaugcaaccauggugcgggucgauguuuuugagaagggggacaaauauuacuuagugccuaucuacagcuggcaaguggccaagggcauucucccagauagggcgguaguccagggaaaggacgaggaagauuggcagcugaucgacgauucuuucaacuuuaaauucucacuucaucccaaugaccugguggagguuauuacaaagaaagcucgcauguucggcuauuuugccaguugccaccgagggaccggaaacaucaauauaagaauccacgaccuagaucauaagauuggcaaaaacgguauccucgaagggauuggagugaagacugcacugagcuuccagaaguaccagaucgacgaguugggcaaagagauacggccuuguaggcugaagaaacgcccuccagucagauga

SEQ ID NO: 2551 - RNA, 3255 nt, Artificial Sequence
  Cas9 variant
augaaguaccacgugggcaucgacgucgggaccuucagcguuggacuggccgcuauugagguggaugacgcagguaugcccauaaaaacacucucccuuguaucucauauccacgauucaggccuggacccugaugaaauuaagagugccgugacuagauuggcgagcuccgggaucgcuaggcggacgcgccgauuauaucguagaaaaaggcggcgccugcagcaacuagacaaguuuauucagagacagggauggccagucaucgagcucgaagauuacucugacccgcuguaucccuggaaagugagggccgagcuugcagccucguacauagcugaugaaaaggagcggggcgagaagcugucaguugcauugcgccauaucgcccgacacagagguuggaggaacccuuaugcuaaagugagcagucucuaccugccagacgggcccuccgaugccuucaaggcgauucgggaagagaucaaacgugcaucuggacagccugucccagaaaccgccacagugggccaaaugguaacucugugcgagcucggcaccuuaaagcugcgcggggagggagguguucuuagcgcuagauugcagcaguccgacuaugccagggaaauucaggagaucugucggaugcaagaaauaggccaggagcuguaccgaaaaauuaucgauguggucuuugcagcugaaucacccaaggggagugccagcucucgcgugggaaaggacccucuacagccaggcaaaaauagagcgcucaaggccuccgacgcauuccagagguaccggauugcugcccugaucgguaaccuucgcgugagagucgauggggagaaaaggauccugucaguugaggaaaagaauuugguguuugaccaucucguaaaccugacaccgaaaaaggagcccgaaugggugaccauugcugagauauuaggaaucgaucguggccaacugauuggcacugccacaaugaccgacgauggggaacgggcaggagcccgaccuccaacgcacgacacuaauagaagcaucgucaacaguaggauagcuccccucguggauugguggaaaaccgcgucugcacuugagcagcacgccaugguuaaggcucuguccaaugccgagguggacgauuucgacagcccugaaggugcaaagguccaggccuuuuucgcugauuuggacgacgaugugcaugccaaacuagacucgcugcaccucccaguaggccgcgcagcguauucugaggauacacugguucggcuuacuagaaggaugcuguccgacgggguggauuuguacaccgcucgccuccaagaauuuggaauugagcccucauggacaccgccuacgccccgaaucggcgaaccagucgguaacccugccguggaccggguccugaagaccgugagucguugguuagagagcgcaacuaaaacauggggagcccccgagagaguuaucauugaacaugugagggagggcuucguaaccgaaaagcgcgcucgggagauggauggagacaugagaaggcgagccgcacgcaaugcuaaacuguuucaggagaugcaggaaaagcuaaacguccagggcaagccaucccgggccgaucucuggagauaucaaucugugcagaggcagaauugccagugugcguacugcgggagccccaucacuuucucaaacagugagauggaccacauuguuccucgugccggacaagguuccacaaauacccgcgaaaaccugguggcugucugucaccggugcaaucagagcaaaggcaacacgccauuugcaauaugggccaagaacaccucuaucgagggggugucaguaaaagaagcuguggagagaacaaggcauuggguuacugauaccggaaugcgaaguacagacuucaagaaauucacuaaggccgucguggagcgguuucagcgcgcaaccauggaugaagagauugacgcgagaagcauggaauccguggccuggauggcuaaugagcuuaggucucgggucgcccagcacuucgcaucgcauggcacaaccguucgaguguauagagguagcuugacugcugaagcccgcagggcauccgggaucucaggcaagcugaaauuuuucgacggagugggcaagagucgucucgaucggagacaccaugccaucgacgcugcgguaauugccuuuacgucugauuacgucgcagagacacuggcugugaggagcaaccuuaaacaaucccaggcccaccgccaggaggccccgcaguggcgagaguucaccgggaaggacgcugaacacagagcagccuggcggguuuggugucagaaaauggaaaagcugucagcguugcucacugaggaucugagggacgaucgcguggucgugaugagcaauguucguuuaagacugggaaacgguucugcucauaaggaaaccauaggcaaacuauccaaggugaaacucaguagccaacugucuguauccgacaucgauaaggccucaagugaggcacuuuggugcgccuugacacgggagcccggguuugacccuaaagaaggacugccagcuaaucccgagaggcacauucgcgucaacggcacccauguguaugcaggggauaauaucggucucuucccugugagcgccggcucgauugcgcugcgaggaggcuacgcugaauuaggguccucuuuucaccacgccagagucuacaagaucacuagcgggaaaaagccagcauucgccaugcugcggguuuauacaauagaccuuuugcccuacaggaaccaggaucucuuuucaguggagcugaagccgcaaacgaugaguaugcgccaggcugagaaaaagcuaagagacgcccuggcaaccggcaaugcugaauaucucgguuggcugguaguggacgaugagcuugucguggacacuuccaaaaucgccacagaucagguuaaggcgguggaagccgaguuggggaccauuaggcgguggcgugucgacggauucuuuucuccuagcaaacugcgcuuacgaccacuccagauguccaaggaaggcaucaagaaagagucagcacccgagcugagcaagauuaucgauagaccugguuggcuucccgcugugaacaaacuguucagugacggcaauguuacaguggucaggcgggauucuuuggggcgcguaagacucgaauccacugcccaucugccagugaccuggaagguucaauga

SEQ ID NO: 2552 - RNA, 2955 nt, Artificial Sequence
  Cas9 variant
auggccagaauccuggcuuucgacauuggcauaagcuccaucgggugggcauuuucugagaacgaugaacucaaggacugcggagugaggauuuucaccaaagucgagaaucccaagacaggugaaucacuugcccugccucggcgcuuggcgcgaagugcucguaaaagauuagccaggcggaaggcacgccugaaccaccuaaaacaucucaucgccaaugaguuuaagcugaacuacgaagauuaucagagcuucgacgagucccuugcuaaggcauacaaaggcucucugauuucgccauaugaguugagauuuagggcccucaaugaacugcugucaaagcaagauuucgcucggguuauccuccacauagccaaacgccgaggguacgacgauaucaagaacagcgacgauaaagagaagggagcgauuuuaaaggcaaucaaacagaaugaagagaagcuggccaacuaucagagugugggcgaguaccuuuauaaagaauacuuucagaaguucaaagaaaauuccaaggaauuuacuaacguaagaaauaaaaaggagucuuacgaaagguguauugcucagagcuucuugaaggacgagcugaaacuaaucuuuaagaaacaacgggaguucgguuuuuccuucucaaagaaauucgaagaggaagugcucagugucgccuuuuauaagcgugcacugaaggauuucagccaucuuguggggaacugcucuuucuuuacggacgagaaacgcgcuccgaagaauaguccccuggccuuuauguucguugcguugaccagaauaauuaaccuccugaauaaccugaaaaacacagaaggaaucuuauacacuaaggaugaccucaaugcccuucugaacgagguguugaaaaauggcacccuaacauauaagcagaccaagaaacugcucggccugucagacgauuacgaguuuaagggggaaaaaggaacuuauuucauugaguuuaagaaauacaaggaguucaucaaggcacuuggugagcacaaccugagccaggacgauuugaaugaaaucgcuaaagacauuacacucauaaaggaugagaucaaacugaagaaagccuuagcuaaguaugaccugaaccaaaaucagauugauagucuaucuaaacucgaguuuaaggaccaucugaacaucuccuucaaggcccuuaaauuggucaccccucugaugcucgaaggcaagaaauacgaugaggcauguaaugaacugaaccuuaagguggccauaaaugaggacaaaaaggauuuucugccagcuuucaacgagacguacuauaaggacgaaguaacuaaucccguuguguugagggcgauuaaagaguaccggaagguccucaacgcacugcugaaaaaguaugggaaagugcacaagaucaauaucgaauuagcccgagaggugggaaagaaccacagccagcgcgcuaaaauugaaaaggagcagaacgagaauuacaaagccaagaaagacgcagaacuagagugcgaaaagcucggccugaagaucaacucgaaaaauauucuuaaguugagacuguucaaagagcaaaaggaauuuugugccuauucuggugagaaaauaaagaucuccgaucuccaggacgagaaaaugcuggaaauugaucauaucuacccuuauucaaggaguuucgacgauagcuacaugaacaaggucuuaguuuuuaccaagcagaaucaagagaaacugaaccagacaccauucgaggcuuuugggaaugacuccgccaaguggcagaaaaucgaagugcuugcaaagaacuugcccacuaaaaagcagaagcggauucucgauaaaaauuacaaggacaaagaacaaaagaacuucaaagaucgcaaucugaacgacaccagauauauagcgaggcuaguacugaauuacacaaaggauuaucucgacuuucugccucuuucugaugacgagaacaccaaguugaaugacacgcagaaaggaagcaaggugcacgucgaggcuaaaucaggcaugcugacuuccgccuuacgucauacauggggcuucuccgcaaaggaucggaacaaccaccuccaccaugccaucgacgcugugauuaucgccuacgcaaauaacagcauuguuaaggcuuuuucugauuucaaaaaggaacaggagucaaauagugccgaacuguaugcgaaaaagaucagcgagcuugacuacaaaaacaagcgaaaauuuuucgagccauuuuccggguucagacagaaggugcuggauaagauagacgaaaucuucgucucuaaaccggagaggaagaaacccucgggagccuugcacgaagagaccuuucgcaaggaagaggaguucuaucaaagcuacgguggcaaagaaggggugcucaaggcucuggagcuaggaaaaauucggaagguaaauggcaagaucguuaaaaacggugauauguuuagaguggacauuuucaagcauaaaaagacuaauaaauuuuacgcagucccuaucuauacaauggauuucgcccugaaggugcucccaaacaaggcugucgccagguccaaaaagggggaaauaaaagacuggauucugauggaugagaauuacgaauuuugcuucucacuuuauaaggacaguuugauccugauucagaccaaagauaugcaggagcccgaguuuguguacuauaacgcauucacgucuagcaccguuuccuuaaucgugucaaagcacgacaauaaguuugaaacacucagcaaaaaccagaagauacuguucaaaaaugcgaacgagaaggaaguaaucgccaaaucuauuggcauccaaaaucuuaaggucuucgagaaguacauuguguccgcucugggagaaguuacuaaagccgaguuucgccagcgagaggacuucaagaaauga

SEQ ID NO: 2553 - RNA, 3366 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauuugguaaggcggacaaaccgccaaggacgacguuuagccagaaggaagaaacaucggcgcgugagacugaauaggcuauuugaggaaucaggccucauuacugacuucacgaagaucaguauaaaccugaauccuuaccagcuucgggucaaaggucugaccgaugaguugagcaacgaagaacucuuuaucgcgcugaagaauauggugaagcaccgcgggauuuccuaucuggacgaugcuucugacgauggaaacucgucaguuggcgacuacgcccagaucgugaaagagaauagcaagcagcucgaaacaaaaacuccaggccaaauucaguuagagcgauaucagaccuacgggcagcugagaggagauuucacagucgaaaaggacgguaaaaagcauaggcuuaucaacguguuuccgaccagugcauaucgguccgaggccuugcguauacugcaaacucagcaggaguucaauccccagauuacagaugaauuuaucaaccgcuaccuagagauucucaccggcaagagaaaauauuaccacgggccuggaaaugaaaagucuaggacggacuacggccgguaucgaacuagcggugagacccuggauaacaucuucgggauccuuauuggaaaaugcacauuuuacccagacgaguuccgcgcugcaaaggccuccuauacugcucaagaguuuaaccuguugaaugaccucaacaaucugaccguacccacagagaccaaaaaguuaucaaaagaacagaagaaccagauaaucaauuacguuaagaacgagaaagccaugggcccugcgaagcuguucaaauauauugcaaagcuccuuaguugugauguggccgacaucaaaggcuacagaauagauaagagcgggaaggcugaaauucauacguuugaggccuauaggaaaaugaagacucuggaaacauuggacaucgagcaaauggaucgggagacccuagacaaacuggcauacguccucacucugaauacagaacgcgagggaauccaggaagcucuugagcacgaguucgccgaugguucuuucucccagaaacagguggacgagcuggugcaauuuagaaaagcgaacucaagcauuuucggcaagggguggcacaauuuuagugucaaguugaugauggagcucaucccagaacuguacgagaccucugaagaacagaugacgauuuuaaccaggcugggaaaacagaagacaacuuccagcucgaacaaaaccaaguauauagaugagaaacuacucacagaagagaucuacaaucccguuguggccaagucuguacgucaggcaauuaagaucgugaacgcugccaucaaagaauauggcgacuucgauaauauugucauagagauggcucgggaaacuaacgaggacgacgagaagaaagccauccaaaagauucagaaagcaaauaaggaugaaaaagacgccgcuaugcugaaggcggcaaaccaguacaacgguaaggccgagcuuccucauuccguguuucacgggcauaaacaguuggcuaccaagauccgacuguggcaccaacagggcgaaagaugccucuauacaggaaaaaccauuucaauccacgaucugauaaauaacaguaaucaguucgagguugaccauauccuuccacugagcauuacuuuugaugacuccuuggccaacaaggugcucgucuacgcaacggccaaucaggaaaaaggccaaaggacaccguaucaggcucuggauucuauggacgaugccuggagcuuccgcgaguuaaaggcauuugugcgggagucaaagacccugaguaacaaaaagaaagaauaccuacucacugaggaagacaucuccaaguucgauguaaggaaaaaguuuauugagagaaaucugguugacacccgcuacgcgagccgagugguccuuaacgcuuugcaggaacacuuccgggcccauaagaucgauacaaaagugucugucgugcgugggcaauuuaccucacagcugagaaggcacuggggaauagagaagacucgcgacacauaucaucaccacgcaguugacgcccucauuaucgcugccaguagccagcugaauuuauggaaaaagcagaaaaacacgcugguguccuacucugaggaucaacuuuuggacauugaaaccggugagcucaucucggaugacgaauauaaggagagcguauucaaggcacccuaccagcauuucgucgauacucugaaauccaaggaguuugaagacucaauacuauucaguuaucagguggauucuaaauuuaaucggaagaucagcgacgcuacaauuuacgccaccagacaggcgaaaguuggcaaggauaaagccgacgagacauaugugcuggggaagaucaaggauauuuacacucaagacggauacgaugcuuucaugaaaaucuauaagaaagacaaguccaaauuucucauguacaggcacgacccucagaccuucgaaaaggucauagagccaauucuggaaaacuaucccaauaagcagaucaacgagaaaggcaaggaggugccuuguaauccauuucuuaaauacaaggaggaacaugguuauauccgaaaauacucaaagaaggggaacggccccgaaauuaagagcuugaaguauuacgauucuaaacugggaaaccacaucgacauuacgccgaaggauuccaauaacaaaguaguguuacagaguguuagcccuuggcgcgcagacgucuacuucaauaagaccacaggcaaguaugagauacucgggcugaaauacgccgaucuucaauuugaaaagggaacugguaccuauaaaaucucucaggagaaguacaacgacauuaaaaagaaggagggcguggauuccgacucagaguucaaauuuacacuguauaagaaugauuugcuccuggugaaagacacugaaaccaaggaacagcaacuauuccgguuucugaguagaacgaugcccaaacagaagcacuacgucgagcucaaaccauaugauaagcagaaguucgaagggggagaggcucugaucaaaguucuuggcaacguggccaauagcggucagugcaagaaaggguugggcaagucgaacauuuccaucuacaaagugaggacagacguacugggaaaucaacauauaaucaagaacgagggcgacaagccuaaauuagauuucuga

SEQ ID NO: 2554 - RNA, 2556 nt, Artificial Sequence
  Cas9 variant
augaccaacggcaagauccuggggcucgacauuggaguggccagcgucgguguuggcauaaucgaggcuaaaacagggaaggugauucacgcaaauuccagacuuuucucugccgcgaacgcugaaaauaacgccgagaggcggggauuucgcggcgcacgacgucugacuagaaggaaaaagcaucggguaaaacgcgugagagauuuguucgaaaaguacgacaucuuaacggauuuuaggaaucugaaccuaaaucccuaugagcuccgggucaagggucugaccgaacagcuuacaaacgaggagcuguucgccgcuuugcgcacuauugcaaaacgaagagggaucucauaccucgacgaugccgaagacgauaguaccggaagcuccgacuaugcuaagucuauagaugagaauaggcggcugcugaaaucgaugacaccuggccaaauccagcucgaacguuuagagaaguacggccagcugcgcgggaacuuuaccguguaugacgagaauggagaagcccacagacuuauuaacguuuucucaacuagcgauuacaaaaaugaggcgaggaagaucuuggaaacacagaguaacuauaauaagcaaauuaccgacgaguuuaucgaagauuacauagagauucugacgcagaaacggaaguacuaucaugguccaggcaacgagaaaucccgaacugacuacgggcgcuucagaaccgacggaacaacucuagaaaacaucuuuggcauucucaucgguaagugcucuuucuauccggaggaauacagggcaagcaaagccuccuauaccgcucaggaguuuaauuuccugaacgaucuuaauaaccugaaggugcccacagaaaccgggaaauugucaacggagcagaaggaguaccucgucaauuuugccaagaacaguaaaacucugggagcaagcaaguuacugaaagaaaucgcuaagcucguggacggcgauguaaaagacauuucuggcuaucgggaggauuccaaggggaagccugaccuucacacauucgaaccauaccgcaaacugaaguucaauuugaccacuguugauauagacaaccuaucaagagauauccuggacaaacucgccgauauucugacacuuaauaccgagagggaaggaaucgaggacgcgauaaaccaaaaucugcccgagcaguuuacgaaggaacagauuagcgagaucgugcagauccguaaaagucaaucuuccgccuucaacaaggguuggcauagcuuuucggcaaaguugaugaaugaacucauuccugagcuguacgcuaccucugaggaacagaugacaaucuuaacucggcuggagaaauucaaggccaccaaaaaguccaguaaaaacacaaagacuauugacgaaaaggagauaaccgaugaaaucuauaauccagucguggcuaaaucagugcgacagacaauuaagaucaucaacgccgcagucaaaaaguacggcgacuuugauaaaauuguuauagagaugcccagagacaagaacgccgaugacgagaaaaaguucaucgauaagaaaaauaaggaaaacaaaaaggagaaagacgauagccuaaagagggcugcguaucucuacaaugggaccgacaagcugccugaugacguguuucacggaaacaaacaacuugcaacuaagauucgcuugugguaucagcagggcgaacggugucuguacuccgguaaaccaauccucauucaggaucugguacacaauucuaacaauuucgagaucgaccauauacuuccgcugagcuugucauuugacgauagucucgccaacaaggugcuggucuaugcuugggccaaucaagaaaaagagcagaagacgcccuaccaggugaucgacuccauggaugcagccuggagcuucagagagaugaaggacuacguuuuaaaacagaaggggauuggcaaaaagaaaagggaauaucugcuaacaaccgagaacaucgauaagauugaagugaagaaaaaguuuaucgagcgcaaucucgucgacacucgauacgcuucucgggugguacugaacucacuucaaaccgccuugaaagaacugggaaaggauacaaaaguuagugugguccguggccaguucaccagccagcucagaaggaaguggaaaauagacaagucccgcgagacuuaucaccaucacgcaguggaugcgcugauuaucgcugccucuucgcaguuaaagcuguggcaaaaacacgagaaucuuauguuugaaaacuacggggagaaucaggucgugaacaaggaaacaggagagauuuugagcaucuccgacgaugaguauaaagaaucaguuuuccagccuccauaccaggguuucgugaacacgauaaguucuaaggcauuugaggacgaaauccucuucagcuaucaaguagauuccaaauuuaaucggaaggucucagacgccaccauuuacagcacuagaaaggcuaaacugggcaaggacaaaaaggaggaaacauacgugcuagggaaauga

SEQ ID NO: 2555 - RNA, 2598 nt, Artificial Sequence
  Cas9 variant
augagacacaagaucggccuggacauugggauaaccagcgugggaugggccgucaucaaccucgauauucccaggaucgaggaccuugguguucggauuuucgaucgcgcugaaaauccucagacaggcgagucccuggcauugccacgacguuuagccagaucugcgaggcggcgccugagaaggcggaaacaucgccuagaacgaaucagaaggcuccugauacgggaggggauccuuacuaaggaggaacuggacaaauuguuugaggaaaagcacgagauugauguguggcaacuccguguagaagcucuggaccgcaaacugaacaaugaugagcucgccagaguguuacugcaucuugcaaagaggcggggauucaagucaaaccgaaaaagugagcgcaauaacaaggaaaauagcacgauguugaaacacaucgaggaaaacagagcccugcuauccggcuacaggaccgucgcugagaugauugugaaggacccgaaauuugcauuccauaagcggaauaagggugaaaacuauacaaauacuaucgcccgcgaugaccucgagagagagauaaaacugauuuuuaccaagcagagggaauacgggaacaucguuugcacagagaccuucgaaaaugaguauauuaugaucugggcuucucagcgucccuuugccucgaaaaacgauaucgaaaagaaagugggauucuguacuuuugagccuaaggagaaacgggcgccaaaggcaacauacaccuuccagucauuugucgccugggaacacauuaauaaacuucgacugguguaucccacgggcacuagaggcuugaccgacgaggaaaggcgccuccuguacaaacaggcuuuccacaagaacaaaauaacauaucaugauauccggacuuuacugcaccucccugacgacaccuacuuuaaggggauuguauacgauagaggagccccacuuaaacaaagcgagacaaucagguuccuggaauuggacgcauaucaucagauacgcaaggcuguugauaagguguacgguaaaggcaagaguuccucuuuccuacccauugacuuugauaccuucggguaugcccugacgcucuuuaaagacgaugcggacauccgaagcuaccugcggaacgaguaugagcagaauggaaagcguaugccuaaccuugccaauaaagucuacgauaacgaaccaaucgaggaacuguugaaucucuccuucacuaaguuuggccaccugucauuaaaggcacugagaaacauucuaccguauauggagcaaggugagguguacaguguggcuugcgaaagggccggguacacauucaccggacccaaaaagaaacagaagacucuccugcuuccuaauaucccacccauugcuaacccugucguuaugcgcgccuugacacaggcacggaaagugguaaaugccauaaucaagaaguauggcagcccagugucuauucacaucgagcuggcuagagaccucucccagaccuuugaugaaaggcgaaaaacgaagcgcgagcaagacgaaaaccggaaaaagaaugagaccgcgaucagacagcugauggaguacggccuuacaauuaaccccacugggcaugacauagucaaauucaagcuguggucagaacagaauggaaggugugcauauagcuugcaaccgaucgagauugaacgucuccuggagccugguuacguggaaguugaucacgugauccccuauagucgcucuuuagacgauuccuacaccaacaaaguccuggugcuaacaaaggagaaucgggagaagggcaacaggauuccagccgaauaucucgggguaggaacugagagauggcagcaguuuaaaaccuucguucugacaaacaagcaguuuagcaaaaagaaacgagaccggcuuuugcgccugcauuacgaugaaaaugaggaagcugaguggaagaacagaaaucucaacgacaccagguacaucucgcgguucuuugccaauuucauacgagagcaccugaaguucgcagaaucugaugacaaacaaaagguguauacugucaacggcagagugacggcccauuuacgcuccaggugggauuuuaauaaaaaccgugaggaaucagaccugcaccacgcugucgaugccgcaaucguggcgugcacaaguccuagcgacauugcucggguuaccgccuucuaccagagaagggagcaguguaaggaguccgcaaagaaggccgaaccccauuuuccacagcccuggccucacuucgcugaugagcuucgcgcccgauugucuaagaauccaaaagaaagcaucaaggcacucaaccuggguaauuaugacgaccaaaaacuagagucacugcagccgguguuuguaaguagaaugcccaagcgguccgucacuggggcugcccaucaggaaacccucaggcgcuacauuggcaucgaugagcguagcggaaaaauacagacagugguuaagaccaagcugucugagauuaaacuugacgaaacuggccacuucccuauguaugggaaggagucagauccacccgcgagugccuga

SEQ ID NO: 2556 - RNA, 2886 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaaccaccuaaaacaucucaucgcuaaugaguuuaagcugaacuacgaagauuaucagagcuucgacgagucccuugcaaaggccuacaaaggcucucugauuucgccauaugaguugagauuuagggcucucaaugaacugcugucaaagcaagauuucgcccgggucauccuccacauagcgaaacgccgaggguacgacgauaucaagaacaauggagacgaggaaaaaggcaagauuuuaaaggcaaucaaacagaacgaggagaagcugguuaauuaucagagcgugggugaauaccuuuauaaagaguacuuucagaaguucaaagaaaacaguaaggaguuuauuaauguaagaaacaaaaaggaauccuacgagagguguaucacucaaucuuucuugaaguaugagcugaaacuaauauuucagaagcagcgggaguucggguuuagcuucuccaaaaaguucgaagaagaggugcucucagucgccuuuuacaaacgugcucugaaggauuucagucaucuugugggaaauugcagcuuuuucucugacgaaaagcgcgccccgaaaaacucaccccuggcauuuauguucguugcuuugacgagaauuaucaaucuccugaacaacuuaaagaauaccgagggcauucuguauacaaaagaugaccucaacgcccuucugaaugagguguugaagaacggcacucuaaccuacaaacagacaaagaagcugcucgggcuguccgaugacuaugaauuuaaaggagagaaggguaccuacuucaucgaauuuaaaaaguauaaagaguucaucaaggcgcuuggcgaacacaaucugagccaagacgauuugaacgagauugccaaggacauaacucucaucaaagaugagauuaagcugaaaaaggcauuagcuaaauacgaccugaaucagaaccagaucgauagucuaucuaagcucgaauuuaaagaccaucugaauauaggguucaaggcccuuaaguugauuacaccucugaugcucgagggaaagaaguacgaugaggcuuguaacgaacugaaucuuaaagucgccaucaacgaggacaagaaagauuuucugccagcauucaaugaaaccuauuacaaggacgaggugacgaaccccguaguuuugagggccaucaaggaauaucggaaagugcucaaugcucuguuaaagaaauacggcaagguccacaaaauuaacaucgagcuggcgcgagaaguggguaagaaccacucccagcgcgcaaagauugagaaagagcaaaaugaaaacuauaaggccaaaaaggaugcugagcuagaaugcgagaaacucgggcugaagauaaauagcaagaacauccuuaaauugagacuguucaaggaacagaaagaguuuugugccuacucgggagagaagauuaaacucucugaccugcaggacgaaaagauguuagagaucgaucauaucuauccuuacuccaggucauucgacgauaguuacaugaauaaagugcuggucuuuacuaagcaaaaccaggaaaaacuuaauaaaaccccauucgaggcauuuggcaacgacaauguuaaguggcagaaaauugaaguguuggccaagaaccuccccgagaaaaagcagaagcggauacuggauaaaaauuauaaggacaaagagcaaaaggauuucaaagaccgcaaccuaaaugauacaagauacaucgcuaggcugguacucaacuauacuaaggacuaccuggauuuucuuccuuugagcgacgaugaaaauaccaagcugaaaggcuccaaggugcacgucgaggccaaaucugggauguuaacaagcgcacuccgucauaccuggggauucucaacgaaggaccggaacaaccaucugcaccacgcgauugacgcugccaucauugcauaugccaauaacaguaucgugaaagauuuuuccgacuucaagaaggaacaggagagcaauucugcugagcuuuacgccaaaaagauaucagaacuggauuauaaaaacaagcgaaaauuuuucgagccauuuagugguuucagacagaagguuuuggacaagaucgaugaaauuuucgugagcaaaccggagaggaagaaacccuccggcgcacuccacgaagagacuuuucgcaaggaggaagaguucuaccagucuuacgggggaaaagaaggcguccugaaggcucuagagcuggguaaaauccggaaggugaaugggaagauuguuaaaaacggcgacauguuuagaguagauaucuucaagcauaaaaagacaaauaaauuuuaugccgugccuauauacaccauggacuucgcgcucaagguccugccaaacaaggccguggcuaggucgaaaaagggagaaauuaaagauuggauccuuauggacgagaauuaugaguuuugcuucagcuuguacaaggauucccugauuuuaauccaaacuaaagacaugcaggaacccgagcucgucuauuuuaacgcauucacaucaaguaccgugucucugauaguuagcaagcacgauaauaaguuugaaacgcuuuccaaaaaccugaagguguucgagaaauacaucguaucagcccuaggcgaagucaccaaggcugaguuccgccagcgagaggacuuuaaaaaugaacuccgguga

SEQ ID NO: 2557 - RNA, 2955 nt, Artificial Sequence
  Cas9 variant
auggccaagauccuggcuuucgacauuggcauaagcuccaucgggugggcauuuucugagaacgaugaacucaaagacugcggagugagaauuuucaccaaggccgagaaucccaaaacaggugaaucacuugcgcugccuaggcggaucgcucgcagugcccgaaagcguuuggcaagaaggaaagcccgguuaaaccaccugaagcaucuaauugcuaaugaguuuaagcucaacuacgaagauuaucagagcuucgacgagauccuggcaaaagccuacaagggcucccuuauaucuccauaugagcugcgcuuuagagcuuugaaugaacuccugucgaaacaagauuucgccagggucauccugcacauugcgaagcggcgcggguacgacgauaucaaaaacaauggagacgaggaaaagggcaagauucucaaagcaaucaagcagaacgaggagaaauuagccaauuaucagucaguuggugaauaccuguauaaggaguacuuucagaaauucaaggaaaacagcaaagaguuuauaaaugugcgaaacaagaaggaaaguuacgagagauguauugcucaauccuuccuuaaagaugaguugaagcugaucuuuaaaaagcagagggaauuuggguuuucuuucagcaaaaaguucgaggaagagguacuauccguggccuuuuauaagcgggcacucaaagacuucucacaucuggucggaaauugcaguuucuucacugaugaaaagcgugcuccgaaaaacagcccccuugccuuuauguucguggcgcugacgcgcauuaucaauuugcucaacaaccugaagaauaccuuauacacaaaagacgaucugaacgcccuccuuaaugagguucugaagaacggcacuuugaccuauaagcagacaaagaagcuacugggccucucugacgacuacgaguuuaaaggggaaaagggaaauuauuucaucgaguuuaaaaaguacaaggaguucauuaaagcacugggugaacacucccuuucacaggaugaccugaacgaaauagcuaaggauaucaccuugauuaaagacgagaucaagcucaaaaaggcccuggcuaaauaugauuuaaaugagaaccaaauagacaaucugagcaagcuagaauuuaaggaucaucucaacauuaguuucaaagcccugaaacuuaucacuccuuugaugcuggagggcaaaaaguacgacgaagcauguaaugagcucacacugaaaguggccaucaacgaggauaagaaggacuuucuuccagcuuucaaugaaaccuacuauaaagaugaggucacgaaccccgugguacugagagcgauuaaggaauacaggaaaguuuugaaugcacuccugaagaaauaugggaaggugcacaagaucaacauugaguuagcccgggaagucggcaaaaaccacucucagcgagcuaagauagagaaagagcagaaugaaaacuacaaggccaaaaaggacgcagagcuggaaugcgagaagcuaggacucaaaaucaauuccaagaacauucugaaacuucgcuuguucaaggaacagaaagaguuuuguguguauagcggugagaagaucaaacugucggaccuccaagaugaaaagaugcuggagaucgaccauauuuacccuuauucuagauccuucgaugacucauacaugaauaagguguuagucuuuacuaaacagaaccaggaaaagcugaaucaaaccccauucgaggccuuugggaacgauagugcuaaauggcagaagauagaaguucuugccaaaaauuugcccacaaagaagcagaaaaggauccucgacaagaacuacaaagauaaggagcagaaagacuucaaggaucggaaucugaacgacacucgcuauauugcaaggcuagugcugaauuacaccaaggauuaucucgacuuucugccucuuagcgaugacgagaacacaaaauugaaugacacccaaaagggauccaaaguacacguggaagcgaagucuggcaugcugacgagcgcuuuaagacauacuuggggcuucucaacaaaagaucguaacaaccaccuccaccaugccaucgacgcagucauuaucgccuacgcuaauaacaguauagugaaggccuuuuccgauuucaagaaagagcaggaaagcaauaccgcagagcuguaugcuaagaaaaucucugagcuugacuacaagaacaaacggaaguuuuucgaaccauuuucaggguuccgacagaagguucuggauaaaauugacgagaucuucgugaguaagccggaaaggaaaaagcccagcggagccuugcacgaggaaacuuuuagaaaagaggaggaguucuaucaguccuacgguggcaaggaagggguccucaaagcgcuggaacuaggaaagauucgcaaggugaauggcaaaaucguaaagaacggugauauguuucggguugacauauucaaacauaagaaaacaaauaaguuuuacgccgugccuauuuauaccauggauuucgcucugaagguccucccaaacaaagcaguggccagaucuaagaaaggggagaucaaggacuggauucugauggaugaaaauuacgaguuuugcuucucgcuuuauaaagacagcuugauccugauacaaacgaaggauaugcaggagcccgaauuugucuacuauaacgcuuucaccuccucaacagugaguuuaaucguuucuaagcacgacaauaaauuugagacucucagcaagaaccagaaaauucuguucaagaaugccaacgaaaaagaggugaucgcaaaguccauuggcauccagaaucuuaagguauucgaaaaauacauagucucagcgcugggagaggugaccaaggccgaguuuaggcaacgcgaagaguucaaaaacgaacuacgauga

SEQ ID NO: 2558 - RNA, 2955 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaacagacuaaaacaccucaucgcuaaugaguuuaagcugaacuacgaagauuaucagagcuucgacgagucccuugcaaaggccuacaaaggcucucugauuucgccauaugaguugagguuucgggcucucaaugaacugcugucaaagcaagauuucgcccgcgucauccuccauauagcgaaacgaagaggguacgacgauaucaagaacagcgacgauaaagagaagggagcaauuuuaaaggccaucaaacagaaugaagagaagcuggcuaacuaucagaguguuggcgaguaccuuuauaaagaauacuuucagaaguucaaagaaaauuccaaggaauuuacuaacgugaggaauaaaaaggagucuuacgaacgguguauugcccaaaguuucuugaaggacgagcugaaacuaaucuuuaagaaacagcgugaguucgguuuuuccuucucaaagaaauucgaagaggaaguacucaguguggcauuuuauaagcgcgcucugaaggauuucagccaccuugucgggaacugcuccuuuuucacggacgagaaaagagccccgaaaaauucuccccuggcguuuauguucguggccuugaccaggauaauuaaccuccugaauaaccugaaaaacacagaaggaaucuuauacacuaaggaugaccucaaugcacuucugaacgaguuuuugaaaaauggcacccuaacauauaagcagaccaagaaacugcucggccugucagacgauuacgaguucaagggggaaaaaggaacuuauuuuauugaguucaagaaauacaaggaauuuaucaaggcucuuggugagcauaaccugagccaggacgauuugaaugaaaucgccaaagacauuacacucauaaaggaugagaucaaacugaagaaggcuuuagccaaguaugaccugaaccaaaaucagauugauagucuaucuaaacucgaguucaaggaccaccugaacaucuccuuuaaggcacuuaaauugauaaccccucugaugcucgaaggcaagaaauacgaugaggccuguaaugaacugaaccuuaagguugcuauuaaugaggacaaaaaggauuuccugccagcguucaacgagacguacuauaaggacgaagugacuaaucccgucguguugcgggcaaucaaagaguaccgaaagguacucaacgcccugcugaaaaaguaugggaaaguucauaagaucaauauugaauuagcucgcgaggugggaaagaacuacagccagagagccaaaaucgaaaaggagcagaacgagaauuauaaagcaaagaaagacgccgaacuagagugcgaaaagcucggccugaagauuaacucgaaaaauauacuuaaguugaggcuguuuaaagagcaaaaggaguucugugcuuacucuggugagaaaaucaagauuuccgaucuccaggacgagaaaaugcuggaaaucgaucacaucuauccuuacucacggaguuuugacgauagcuacaugaacaaggucuuaguguucaccaagcagaaucaagagaaacugaaccagacaccauuugaagccuucgggaaugacuccgcaaaguggcagaaaauugaggugcuugcgaagaacuugcccacuaaaaagcagaagcgcauacucgauaaaaauuauaaggacaaagaacaaaaggauuuuaaagacagaaaccugaaugauaccagguacaucgcucgucuaguccugaacuauacaaaggacuaccucgauuuccugccucuuucugacgacgagaauaccaaguugaacgauacgcacaaaggaagcaagguucauguggaggccaaaucaggcaugcugacuagcgcauuacggcacacauggggcuuuuccaccaaggaccgaaauaaccaucucagacacgccauugaugcuguaaucauugccuaugcaaacaauagcaucgugaaggcuuucucugacuuuaaaaaggaacaggagucaaacagugccgaacuguacgcgaaaaagauaagcgagcuugauuauaaaaauaagaggaaauucuuugagccauucuccggguuccgccagaagguccuggacaagaucgaugaaauuuuugugucuaaaccggagcggaagaaacccucgggagccuugcacgaagagacuuucagaaaggaagaggaguuuuaccagagcuacgguggcaaagaagggguucucaaggcucuggagcuaggaaaaaucaggaaggugaacggcaagauugucaaaaauggugacauguuccgcguggauaucuuuaagcauaaaaagacaaacaaauucuaugcaguaccuauauacaccauggacuuugcccugaagguucucccaaauaaggcuguggcccgauccaaaaagggggaaauuaaagauuggauccugauggacgagaacuaugaguucugcuuuucacuuuacaaggauaguuugauucugauccaaacgaaagacaugcaggaacccgaguucgucuauuacaaugcauuuaccucuagcacaguguccuuaauagucucaaagcacgacaacaaguucgaaacucucagcaaaaaucagaagauccuguucaaaaacgcgaaugagaaggaagugauugccaaaucuaucggcauucagaaccuuaagguuuuugagaaguauaucguguccgcucugggagaaguaaccaaagccgaguuccggcaacgugaggauuuuaagaaauga

SEQ ID NO: 2559 - RNA, 2955 nt, Artificial Sequence
  Cas9 variant
auggccagaauccuggcuuucgacauuggcauaagcuccaucgggugggcauuuucugagaacgaugaacucaaggacugcggagugaggauuuucaccaaagucgagaaucccaagacaggugaaucacuugcccugccucggcgcuuggcgcgaagugcucguaaaagauuagccaggcggaaggcacgccugaaccaccuaaaacaucucaucgccaaugaguuuaagcugaacuacgaagauuaucagagcuucgacgagucccuugcuaaggcauacaaaggcucucugauuucgccauaugaguugagauuuagggcccucaaugaacugcugucaaagcaagauuucgcucggguuauccuccacauagccaaacgccgaggguacgacgauaucaagaacagcgacgauaaagagaagggagcgauuuuaaaggcaaucaaacagaaugaagagaagcuggccaacuaucagagugugggcgaguaccuuuauaaagaauacuuucagaaguucaaagaaaauuccaaggaauuuacuaacguaagaaauaaaaaggagucuuacgaaagguguauugcucaaucuuucuugaaggacgagcugaaacuaaucuuuaagaaacagcgggaguucgguuuuuccuucucaaagaaauucgaagaggaagugcucagugucgccuuuuauaagcgugcacugaaggauuucagccaucuuguggggaacugcagcuuuuucacggacgagaaacgcgcuccgaaaaauucccccuuagccuuuauguucguuaccuugacaagaauaauuaaccuccugaauaaccugaaaaacacugaaggaauccuguacaccaaggaugaccucaaugcgcuucugaacgagguguugaaaaauggcacacuaaccuauaagcagacuaagaaacugcucggccugucagacgauuacgaguuuaagggggaaaaaggaacauauuucauugaguuuaagaaauacaaggaguucaucaaggcccuuggugagcacaaccugagccaggacgauuugaaugaaaucgcaaaagacauuacccucauaaaggaugagaucaaacugaagaaggcuuuagccaaguaugaccugaaccaaaaucagauugauagucuaucuaaacucgaguuuaaggaccaucugaacaucuccuucaaggcucuuaaauugauaacgccucugaugcucgaaggcaagaaauacgaugaggccuguaaugaacugaaccuuaaggucgcaauuaaugaggacaaaaaggauuuucugccagccuucaacgagacuuacuauaaggacgaagugaccaaucccguaguuuugagggcuaucaaagaguaccggaaggugcucaacgcgcugcugaaaaaguaugggaaaguccacaagaucaauauugaauuagcacgagaggugggaaagaaccacagccagcgcgccaaaaucgaaaaggagcagaacgagaauuacaaagcuaagaaagacgccgaacuagagugcgaaaagcucggccugaagauuaacucgaaaaauauacuuaaguugagacuguucaaagagcaaaaggaauuuugugcauauucuggugagaaaaucaagauuuccgaucuccaggacgagaaaaugcuggaaaucgaucauaucuacccuuauucaaggaguuucgacgauagcuacaugaacaagguguuagucuuuacaaagcagaaucaagagaaacugaacaagacuccauucgaagccuuugggaaugacuccgcuaaauggcagaagauugagguucuugccaaaaacuugcccaccaagaagcagaaacggauacucgauaagaauuacaaagacaaggaacagaaagauuucaaggaccgcaaccugaaugauacaagauauaucgcaaggcuagugcugaacuacaccaaggacuaucucgauuuucugccucuuucugacgacgagaauacgaaauugaacgauacucaaaagggaagcaaaguacacguggaggcgaagucaggcaugcugacaagugcuuuacgucauaccuggggcuucuccacuaaagaccggaauaaccaccuccaccaugccauugaugcagucaucauugccuacgcuaacaauagcaucgugaaggccuuuucugacuucaagaaagaacaggagucaaacagugcagaacuguaugcuaagaaaauaagcgagcuugauuacaagaauaaacgaaaguuuuucgagccauuuuccggguucagacagaagguucuggacaaaaucgaugaaauuuucgugucuaagccggagaggaaaaagcccucgggagccuugcacgaagagacauuucgcaaagaagaggaguucuaucagagcuacgguggcaaggaagggguccucaaagcgcuggagcuaggaaagauccggaaggugaacggcaaaauuguaaagaauggugacauguuuagaguugauaucuucaaacauaagaaaaccaacaaguuuuacgccgugccuauauauacgauggacuucgcucugaagguccucccaaauaaagcaguggccagguccaagaaaggggaaauuaaggauuggauccugauggacgagaacuacgaauuuugcuucucacuuuauaaagauaguuugauucugauccaaaccaaggacaugcaggagcccgaguuugucuacuauaaugcuuucacaucuagcacuguguccuuaauaguuucaaagcacgacaacaaauuugaaacccucagcaagaaucagaaaauccuguucaagaacgccaaugagaaagaagugauugcaaagucuaucggcauucagaaccuuaagguauucgagaaauacaucgucuccgcgcugggagaagugacaaaggccgaguuucgccaacgagaggauuucaaaaaguga

SEQ ID NO: 2560 - RNA, 2955 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaaccaccuaaaacaucucaucgcuaaugaguuuaagcugaacuacgaagauuaucagagcuucgacgagucccuugcaaaggccuacaaaggcucucugauuucgccauaugaguugagauuuagggcucucaaugaacugcugucaaagcaagauuucgcccgggucauccuccacauagcgaaacgccgaggguacgacgauaucaagaacagcgacgauaaagagaagggagcaauuuuaaaggccaucaaacagaaugaagagaagcuggcuaacuaucagaguguuggcgaguaccuuuauaaagaauacuuucagaaguucaaagaaaauuccaaggaauuuacuaacgugagaaauaaaaaggagucuuacgaaagguguauugcccaauccuucuugaaggacgagcugaaacuaaucuuuaagaaacagcgggaguucgguuuuuccuucucaaagaaauucgaagaggaaguacucaguguggcauuuuauaagcgugcucugaaggauuucagccaucuugucgggaacugcucauuuuucacggacgagaaacgcgccccgaagaauagcccccuggcguuuauguucguggccuugaccagaauaauuaaccuccugaauaaccugaaaaacacagaaggaaucuuauacacuaaggaugaccucaaugcacuucugaacgagguuuugaaaaauggcacccuaacauauaagcagaccaagaaacugcucggccugucugacgauuacgaguuuaagggggaaaaaggaacuuauuucauugaguuuaagaaauacaaggaguucaucaaggcucuuggugaccacagccugagucaggaugacuugaacgagaucgccaaagauauuacacucauaaaggacgaaaucaaacugaagaaagcauuagccaaguaugaucugaaucaaaaccagauugacucucuauccaaacucgaguuuaaggaucaucugaauaucagcuucaaggcacuuaaauugauaaccccucugaugcucgagggcaagaaauacgacgaagccuguaacgagcugaaucuuaagguggcuauuaacgaagauaaaaaggacuuucugccagcguucaaugagacguacuauaaggacgaggucacuaaccccgugguauugagggcaaucaaagaauaccggaagauccucaaugcccugcugaaaaaguaugggaaaguucacaagauuaacaucgaguuagcucgagaagugggaaagaaucacucgcagcgcgccaaaauugagaaggaacagaacgagaacuacaaagcaaagaaagaugccgagauagaaugcgagaagcuaggccucaagaucaauucuaaaaacauucugaaacuuagauuguucaaagaacaaaaggaguuuugugcuuauuccggugaaaagaucaagcugucagaccuccaggaugagaaaaugcuggagaucgaccauauuuacccuuauaguaggagcuucgaugacuccuacaugaauaaggucuuaguguuuaccaagcagaaccaagaaaaacugaauaagacaccauucgaggccuuugggaacgauucuacuaaauggcagaagauagaagugcuugcuaaaaauuugcccgagaagaagcagaaacggauccucgacaagaacuacaaagauaaggaacagaaagacuucaaggaucgcaaucugaacgacaccagauauauugcgaggcuaguccugaauuacacaaaggauuaucucgacuuucugccucuuagcgacgaugagaacaccaaauugaaugacacgcaaaagggaucaaaaguucacguggaggcuaagaguggcaugcugacuuccgccuuacgucauacauggggcuucagcgcaaaagaucggaacaaucaccuccaccaugccaucgacgcugccauuaucgcauacgcuaacaacucuauaguaaaggccuuuucagauuucaagaaagaacaggagaguaauagcguggaacuguaugcgaagaaaaucuccgagcuugacuacaagaacaaacgaaaguuuuucgagccauuuucuggguucagacagaagguccuggauaaaauugacgaaaucuucgugucgaagccggagaggaaaaagcccagcggagccuugcacgaagagaccuuucgcaaagaagaggaguucuaucaguccuacgguggcaaggaagggguucucaaagcucuggagcuaggaaagauucggaaggugaauggcaaaaucgucaagaacggugauauguuuagaguggacauauucaaacauaagaaaacuaauaaguuuuacgcaguaccuauuuauacaauggauuucgcccugaagguucucccaaacaaagcuguggccaggucaaagaaaggggaaaucaaggacuggauucugauggaugagaauuacgaauuuugcuucagucuuuauaaagacucuuugauccugauacaaaccaaggacaugcaggagcccgaguuagucuacuuuaacgcauucacgagcuccaccgugucacucaucgucagcaagcacgauaauaaauuugaaacacugucuaagaaccagaaaauucuuuucaagaaugcgaacgagaaagaagugaucgccaaguccauuggcauccagaaucugaagguuuucgagaaauauauagugagugcucuaggagaaguaacuaaggccgaguuucgccaacgagaggacuucaaaaaguga

SEQ ID NO: 2561 - RNA, 2955 nt, Artificial Sequence
  Cas9 variant
auggccagaauccuggcuuucgacauuggcauaagcuccaucgggugggcauuuucugagaacgaugaacucaaggacugcggagugaggauuuucaccaaagucgagaaucccaagacaggugaaucacuugcccugccucggcgcuuggcgcgaagugcucguaaaagauuagccaggcggaaggcacgccugaaccaccuaaaacaucucaucgccaaugaguuuaagcugaacuacgaagauuaucagagcuucgacgagucccuugcuaaggcauacaaaggcucucugauuucgccauaugaguugagauuuagggcccucaaugaacugcugucaaagcaagauuucgcucggguuauccuccacauagccaaacgccgaggguacgacgauaucaagaacagcgacgauaaagagaagggagcgauuuuaaaggcaaucaaacagaaugaagagaagcuggccaacuaucagagugugggcgaguaccuuuauaaagaauacuuucagaaguucaaagaaaauuccaaggaauuuacuaacguaagaaauaaaaaggagucuuacgaaagguguauugcucagagcuucuugaaggacgagcugaaacuaaucuuuaagaaacaacgggaguucgguuuuuccuucucaaagaaauucgaagaggaagugcucagugucgccuuuuauaagcgugcacugaaggauuucagccaucuuguggggaacugcucuuucuuuacggacgagaaacgcgcuccgaagaauaguccccuggccuuuauguucguugcguugaccagaauaauuaaccuccugaauaaccugaaaaacacagaaggaaucuuauacacuaaggaugaccucaaugcccuucugaacgagguguugaaaaauggcacccuaacauauaagcagaccaagaaacugcucggccugucagacgauuacgaguuuaagggggaaaaaggaacuuauuucauugaguuuaagaaauacaaggaguucaucaaggcacuuggugagcacaaccugagccaggacgauuugaaugaaaucgcuaaagacauuacacucauaaaggaugagaucaaacugaagaaagccuuagcuaaguaugaccugaaccaaaaucagauugauagucuaucuaaacucgaguuuaaggaccaucugaacaucuccuucaaggcccuuaaauugauaaccccucugaugcucgaaggcaagaaauacgaugaggcauguaaugaacugaaccuuaaggucgccauuaaugaggacaaaaaggauuuucugccagcuuucaacgagacguacuauaaggacgaagugacuaaucccguaguuuugagggcgaucaaagaguaccggaaggugcucaacgcacugcugaaaaaguaugggaaaguccacaagaucaauauugaauuagcccgagaggugggaaagaaccacagccagcgcgcuaaaaucgaaaaggagcagaacgagaauuacaaagccaagaaagacgcagaacuagagugcgaaaagcucggccugaagauuaacucgaaaaauauacuuaaguugagacuguucaaagagcaaaaggaauuuugugccuauucuggugagaaaaucaagauuuccgaucuccaggacgagaaaaugcuggaaaucgaucauaucuacccuuauucaaggaguuucgacgauagcuacaugaacaagguguuagucuuuaccaagcagaaucaagagaaacugaacaagacaccauucgaagcauuugggaaugacuccgccaaauggcagaagauugagguucuugcuaaaaacuugcccacuaagaagcagaaacggauacucgauaagaauuacaaagacaaggaacagaaagauuucaaggaccgcaaccugaaugauaccagauauaucgcgaggcuagugcugaacuacacaaaggacuaucucgauuuucugccucuuucugacgacgagaauaccaaauugaacgauacgcaaaagggaagcaaaguacacguggaggcuaagucaggcaugcugacuuccgccuuacgucauacauggggcuucuccaccaaagaccggaauaaccaccuccaccaugcaauugaugccgucaucauugcuuacgccaacaauagcaucgugaaggcauuuucugacuucaagaaagaacaggagucaaacagugcugaacuguaugccaagaaaauaagcgagcuugauuacaagaauaaacgaaaguuuuucgagccauuuuccggguucagacagaagguucuggacaaaaucgaugaaauuuucgugucuaagccggagaggaaaaagcccucgggagcguugcacgaagagacuuuucgcaaagaagaggaguucuaucagagcuacgguggcaaggaagggguccucaaagcccuggagcuaggaaagauccggaaggugaacggcaaaauuguaaagaauggugacauguuuagaguugauaucuucaaacauaagaaaacaaacaaguuuuacgcugugccuauauauaccauggacuucgcacugaagguccucccaaauaaagccguggcuagguccaagaaaggggaaauuaaggauuggauccugauggacgagaacuacgaauuuugcuucucacuuuauaaagauaguuugauucugauccaaacgaaggacaugcaggagcccgaguuugucuacuauaaugccuucaccucuagcacaguguccuuaauaguuucaaagcacgacaacaaauuugaaacucucagcaagaaucagaaaauccuguucaagaacgcaaaugagaaagaagugauugcgaagucuaucggcauucagaaccuuaagguauucgagaaauacaucgucuccgcccugggagaagugaccaaggcugaguuucgccaacgagaggauuucaaaaaguga

SEQ ID NO: 2562 - RNA, 2955 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaaccaccuaaaacaucucaucgcuaaugaguuuaagcugaacuacgaagauuaucagagcuucgacgagucccuugcaaaggccuacaaaggcucucugauuucgccauaugaguugagauuuagggcucucaaugaacugcugucaaagcaagauuucgcccgggucauccuccacauagcgaaacgccgaggguacgacgauaucaagaacagcgacgauaaagagaagggagcaauuuuaaaggccaucaaacagaaugaagagaagcuggcuaacuaucagaguguuggcgaguaccuuuauaaagaauacuuucagaaguucaaagaaaauuccaaggaauuuacuaacgugagaaauaaaaaggagucuuacgaaagguguauugcccaaaguuucuugaaggacgagcugaaacuaaucuuuaagaaacagcgggaguucgguuuuuccuucucaaagaaauucgaagaggaaguacucaguguggcauuuuauaagcgugcucugaaggauuucagccaucuugucgggaacugcuccuuuuucacggacgagaaacgcgccccgaaaaauucuccccuggcguuuauguucguggccuugaccagaauaauuaaccuccugaauaaccugaaaaacacagaaggaaucuuauacacuaaggaugaccucaaugcacuucugaacgagguuuugaaaaauggcacccuaacauauaagcagaccaagaaacugcucggccugucagacgauuacgaguuuaagggggaaaaaggaacuuauuucauugaguuuaagaaauacaaggaguucaucaaggcucuuggugaccacagccugagucaggaugacuugaacgagaucgccaaagauauuacacucauaaaggacgaaaucaaacugaagaaggcuuuagccaaguaugaucugaaucaaaaccagauugacucucuauccaaacucgaguuuaaggaucaucugaauaucagcuucaaggcacuuaaauugauaaccccucugaugcucgagggcaagaaauacgacgaagccuguaacgagcugaaucuuaagguggcuauuaacgaagauaaaaaggacuuucugccagcguucaaugagacguacuauaaggacgaggucacuaaccccgugguauugagggcaaucaaagaauaccggaagguucucaaugcccugcugaaaaaguaugggaaagugcacaagaucaacauugaguuagcucgagaagucggaaagaauuacucgcagcgcgccaaaaucgagaaggaacagaacgagaacuauaaagcaaagaaagaugccgagcuagaaugcgagaagcucggccugaagauuaauucuaaaaacauacuuaaguugagacuguucaaagaacaaaaggaguuuugugcuuacuccggugaaaagaucaaaauuucagaccuccaggaugagaaaaugcuggagaucgaccacaucuauccuuacaguaggagcuucgaugacuuuuacaugaauaagguguuaguguucaccaagcagaaccaagaaaaacugaaucagacaccauuugaggccuucgggaacgauuccgcaaaguggcagaaaauugaaguccuugcgaagaauuugcccacuaaaaagcagaagcggauacucgacaaaaacuauaaggauaaagagcaaaaggacuuuaaagaucgcaaucugaacgacaccagauacaucgcuaggcuaguucugaauuauacaaaggauuaccucgacuuccugccucuuucugacgaugaaaacaccaaguugaaugacacgcagaaaggaagcaaggugcauguagaggccaaaucaggcaugcugacuagcgcauuacgucacacauggggcuuuuccgccaaggaucggaacaaucaucuccaccacgcuauugacgccgugaucauugcauaugcuaacaacagcaucgucaaagccuucucugauuuuaagaaggagcaggaaucaaauagugcggagcuguacgccaaaaagauaagcgaacuugacuauaaaaacaagcgaaaauucuuugagccauucuccggguucagacagaaggugcuggauaagaucgacgagauuuuuguuucuaaaccggaaaggaagaaacccucgggagcuuugcaugaggaaaccuuccgcaaggaggaagaguuuuaccaaagcuacgguggcaaagagggggugcucaaggcacuggaacuaggaaaaauccggaaggucaauggcaagauugugaaaaacggugauauguucagaguagacaucuuuaagcacaaaaagacuaauaaauucuaugccguuccuauauacacaauggauuuugcucugaaggugcucccaaacaaggccgucgcaagguccaaaaagggggagauuaaagacuggauccugauggaugaaaauuaugaguucugcuuuucacuuuacaaggacaguuugauucugauccagaccaaagacaugcaggaacccgaguucguguauuacaacgcguuuacgucuagcaccgucuccuuaauagugucaaagcaugauaauaaguucgagacacucagcaaaaaccagaagauccuguucaaaaaugccaacgaaaaggagguuauugcuaaaucuaucggcauucaaaaucuuaagguguuugaaaaguauaucguauccgcccugggagaggucacuaaagcagaguuccgccagcgagaagacuuuaagaaauga

SEQ ID NO: 2563 - RNA, 2955 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaaccaccuaaaacaucucaucgcuaaugaguuuaagcugaacuacgaagauuaucagagcuucgacgagucccuugcaaaggccuacaaaggcucucugauuucgccauaugaguugagauuuagggcucucaaugaacugcugucaaagcaagauuucgcccgggucauccuccacauagcgaaacgccgaggguacgacgauaucaagaacagcgacgauaaagagaagggagcaauuuuaaaggccaucaaacagaaugaagagaagcuggcuaacuaucagaguguuggcgaguaccuuuauaaagaauacuuucagaaguucaaagaaaauuccaaggaauuuacuaacgugagaaauaaaaaggagucuuacgaaagguguauugcccaaaguuucuugaaggacgagcugaaacuaaucuuuaagaaacagcgggaguucgguuuuuccuucucaaagaaauucgaagaggaaguacucaguguggcauuuuauaagcgugcucugaaggauuucagccaucuugucgggaacugcuccuuuuucacggacgagaaacgcgccccgaaaaauucuccccuggcguuuauguucguggccuugaccagaauaauuaaccuccugaauaaccugaaaaacacagaaggaaucuuauacacuaaggaugaccucaaugcacuucugaacgaguuuuugaaaaauggcacccuaacauauaagcagaccaagaaacugcucggccugucagacgauuacgaguucaagggggaaaaaggaacuuauuuuauugaguucaagaaauacaaggaauuuaucaaggcucuuggugagcacaaccugagccaggacgauuugaaugaaaucgccaaagacauuacacucauaaaggaugagaucaaacugaagaaggcuuuagccaaguaugaccugaaccaaaaucagauugauagucuaucuaaacucgaguucaaggaccaucugaacaucuccuuuaaggcacuuaaauugauaaccccucugaugcucgaaggcaagaaauacgaugaggccuguaaugaacugaaccuuaagauugcuaucaaugaggacaaaaaggauuuccugccagcguucaacgagacguacuauaaggacgaaguuacuaaucccguggucuugagggcaaucaaagaguaccggaaggugcucaacgcccugcugaaaaaguaugggaaaguacacaagauuaauaucgaauuagcucgagagguuggaaagaaccacagccagcgcgccaaaauugaaaaggagcagaacgagaauuacaaagcaaagaaagacgccgaacuagagugcgaaaagcucggccugaagauaaacucgaaaaauauccuuaaguugagacuguuuaaagagcaaaaggaguucugugcuuauucuggugagaaaauuaagaucuccgaucuccaggacgagaaaaugcuggaaaucgaucauauuuacccuuauucaaggaguuuugacgauagcuacaugaacaagguguuagucuucaccaagcagaaucaagagaaacugaaccagacaccauuugaagccuucgggaaugacuccgcaaaguggcagaaaauagaggugcuugcgaagaacuugcccacuaaaaagcagaagcggauccucgauaaaaauuacaaggacaaagaacaaaagaacuuuaaagaucgcaaucugaacgacaccagauauauugcuaggcuagugcugaauuacacaaaggauuaucucgacuuccugccucuuucugaugacgagaacaccaaguugaaugacacgcagaaaggaagcaagguccacguugaggccaaaucaggcaugcugacuagcgcauuacgucauacauggggcuuuuccgccaaggaucggaacaaccaccuccaccaugcuaucgacgccgugauuaucgcauacgcuaauaacagcauaguaaaagccuucucugauuuuaagaaggaacaggagucaaauagugcggaacuguaugccaaaaagaucagcgagcuugacuacaaaaacaagcgaaaauucuuugagccauucuccggguucagacagaaggugcuggauaagauugacgaaaucuuugucucuaaaccggagaggaagaaacccucgggagcuuugcacgaagagaccuuccgcaaggaagaggaguuuuaucaaagcuacgguggcaaagaaggggugcucaaggcacuggagcuaggaaaaauucggaagguuaauggcaagaucgugaaaaacggugauauguucagagucgacauauuuaagcauaaaaagacuaauaaauucuacgccgugccuauuuauacaauggauuuugcucugaagguacucccaaacaaggccguugcaagguccaaaaagggggaaaucaaagacuggauucugauggaugagaauuacgaguucugcuuuucacuuuauaaggacaguuugauccugauacagaccaaagauaugcaggaacccgaguucguguacuauaacgcguuuacgucuagcaccgucuccuuaaucgugucaaagcacgacaauaaguucgaaacacucagcaaaaaccagaagauucuguucaaaaaugccaacgagaaggaagucaucgcuaaaucuauuggcauccaaaaucuuaagguguuugagaaguacauaguuuccgcccugggagaagugacuaaagcagaguuccgccagcgagaggacuuuaagaaauga

SEQ ID NO: 2564 - RNA, 2955 nt, Artificial Sequence
  Cas9 variant
auggugagaauccuggccuucgacauuggcauaagcuccaucgggugggcuuuuucugagaacgaugaacucaaggacugcggagucaggauuuucaccaaaguugagaaucccaagacaggugaaucacuugcacugccucggcgcuuggcccgaagugcgcguaaaagauuagcuaggcggaaggcccgccugaaccaccuaaaacaucucaucgcaaaugaguuuaagcugaacuacgaagauuaucagagcuucgacgagucccuugccaaggcuuacaaaggcucucugauuucgccauaugaguugagauuuagggcacucaaugaacugcugucaaagcaagauuucgcccgggugauccuccacauagcuaaacgccgaggguacgacgauaucaagaacagcgacgauaaagagaagggagccauuuuaaaggcgaucaaacagaaugaagagaagcuggcaaacuaucagaguguaggcgaguaccuuuauaaagaauacuuucagaaguucaaagaaaauuccaaggaauuuacuaacgugagaaauaaaaaggagucuuacgaaagguguauugcccaaaguuucuugaaggacgagcugaaacuaaucuuuaagaaacagcgggaguucgguuuuuccuucucaaagaaauucgaagaggaaguccucaguguggcuuuuuauaagcgugcccugaaggauuucagccaucuuguugggaacugcuccuuuuucacggacgagaaacgcgcaccgaaaaauucuccccuggcuuuuauguucguggccuugaccagaauaauuaaccuccugaauaaccugaaaaacacagaaggaaucuuauacacuaaggaugaccucaaugcgcuucugaacgaggucuugaaaaauggcacccuaacauauaagcagaccaagaaacugcucggccugucagacgauuacgaguuuaagggggaaaaaggaacuuauuucauugaguuuaagaaauacaaggaguucaucaaggcccuuggugagcacaaccugagccaggacgauuugaaugaaaucgcaaaagacauuacacucauaaaggaugagaucaaacugaagaaggcuuuagccaaguaugaccugaaccaaaaucagauugauagucuaucuaaacucgaguuuaaggaccaucugaacaucuccuucaaggcucuuaaauugauaaccccucugaugcucgaaggcaagaaauacgaugaggccuguaaugaacugaaccuuaagguggcaauuaaugaggacaaaaaggauuuucugccagccuucaacgagacguacuauaaggacgaaguaacuaaucccguuguguugagggcuaucaaagaguaccggaagguccucaacgcgcugcugaaaaaguaugggaaagugcacaagaucaauauugaauuagcacgagaggugggaaagaaccacagccagcgcgccaaaaucgaaaaggagcagaacgagaauuacaaagcuaagaaagacgccgaacuagagugcgaaaagcucggccugaagauuaacucgaaaaauauacuuaaguugagacuguucaaagagcaaaaggaauuuugugcauauucuggugagaaaaucaagauuuccgaucuccaggacgagaaaaugcuggaaaucgaucauaucuacccuuauucaaggaguuucgacgauagcuacaugaacaaggucuuaguuuuuaccaagcagaaucaagagaaacugaacaagacaccauucgaagccuuugggaaugacuccgcuaaauggcagaagauugaggugcuugccaaaaacuugcccacuaagaagcagaaacggauacucgauaagaauuacaaagacaaggaacagaaagauuucaaggaccgcaaccugaaugauaccagauauaucgcaaggcuaguacugaacuacacaaaggacuaucucgauuuucugccucuuucugacgacgagaauaccaaauugaacgauacgcaaaagggaagcaaagugcacgucgaggcgaagucaggcaugcugacuagcgcuuuacgucauacauggggcuucuccaccaaagaccggaauaaccaccuccaccaugccauugaugcagugaucauugccuacgcuaacaauagcaucguuaaggccuuuucugacuucaagaaagaacaggagucaaacagugcagaacuguaugcuaagaaaauaagcgagcuugauuacaagaauaaacgaaaguuuuucgagccauuuuccggguucagacagaaggugcuggacaaaaucgaugaaauuuucgucucuaagccggagaggaaaaagcccucgggagccuugcacgaagagacuuuucgcaaagaagaggaguucuaucagagcuacgguggcaaggaaggggugcucaaagcgcuggagcuaggaaagauccggaagguaaacggcaaaauuguuaagaauggugacauguuuagaguggauaucuucaaacauaagaaaacaaacaaguuuuacgccgucccuauauauaccauggacuucgcucugaaggugcucccaaauaaagcagucgccagguccaagaaaggggaaauuaaggauuggauccugauggacgagaacuacgaauuuugcuucucacuuuauaaagauaguuugauucugauccaaacgaaggacaugcaggagcccgaguuuguguacuauaaugcuuucaccucuagcacaguuuccuuaauagugucaaagcacgacaacaaauuugaaacucucagcaagaaucagaaaauccuguucaagaacgccaaugagaaagaaguaauugcaaagucuaucggcauucagaaccuuaaggucuucgagaaauacaucguguccgcgcugggagaaguuaccaaggccgaguuucgccaacgagaggauuucaaaaaguga

SEQ ID NO: 2565 - RNA, 2955 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaaccaccuaaaacaucucaucgcuaaugaguuuaagcugaacuacgaagauuaucagagcuucgacgagucccuugcaaaggccuacaaaggcucucugauuucgccauaugaguugagauuuagggcucucaaugaacugcugucaaagcaagauuucgcccgggucauccuccacauagcgaaacgccgaggguacgacgauaucaagaacagcgacgauaaagagaagggagcaauuuuaaaggccaucaaacagaaugaagagaagcuggcuaacuaucagaguguuggcgaguaccuuuauaaagaauacuuucagaaguucaaagaaaauuccaaggaauuuacuaacgugagaaauaaaaaggagucuuacgaaagguguauugcccagagcuucuugaaggacgagcugaaacuaaucuuuaagaaacaacgggaguucgguuuuuccuucucaaagaaauucgaagaggaaguacucaguguggcauuuuauaagcgugcucugaaggauuucagccaucuugucgggaacugcucauuuuucacggacgagaaacgcgccccgaaaaauucccccuuagcguuuauguucguggccuugaccagaauaauuaaccuccugaauaaccugaaaaacacagaaggaauccuguacacuaaggaugaccucaaugcacuucugaacgagguuuugaaaaauggcacccuaacauauaagcagaccaagaaacugcucggccugucagacgauuacgaguuuaagggggaaaaaggaacuuauuucauugaguuuaagaaauacaaggaguucaucaaggcucuuggugaccacagccugagucaggaugacuugaacgagaucgccaaagauauuacacucauaaaggacgaaaucaaacugaagaaggcuuuagccaaguaugaucugaaucaaaaccagauugacucucuauccaaacucgaguuuaaggaucaucugaauaucagcuucaaggcacuuaaauugauaaccccucugaugcucgagggcaagaaauacgacgaagccuguaacgagcugaaucuuaagguggcuauuaacgaagauaaaaaggacuuucugccagcguucaaugagacguacuauaaggacgaggucacuaaccccgugguauugagggcaaucaaagaauaccggaagguucucaaugcccugcugaaaaaguaugggaaagugcacaagaucaacauugaguuagcucgagaagucggaaagaauuacucgcagcgcgccaaaaucgagaaggaacagaacgagaacuauaaagcaaagaaagaugccgagcuagaaugcgagaagcucggccugaagauuaauucuaaaaacauacuuaaguugagacuguucaaagaacaaaaggaguuuugugcuuacuccggugaaaagaucaaaauuucagaccuccaggaugagaaaaugcuggagaucgaccacaucuauccuuacaguaggagcuucgaugacuccuacaugaauaagguguuaguguuuaccaagcagaaccaagaaaaacugaaucagacaccauucgaggccuuugggaacgauucugcaaaguggcagaaaauugaaguccuugcgaagaauuugcccacuaaaaagcagaagcggauacucgacaaaaacuauaaggauaaagagcaaaaggacuucaaagaucgcaaucugaacgacaccagauacaucgcuaggcuaguucugaauuauacaaaggauuaccucgacuuucugccucuuagcgacgaugaaaacaccaaguugaaugacacgcagaaaggaucaaaggugcauguagaggccaaaaguggcaugcugacuuccgcauuacgucacacauggggcuucagcgccaaggaucggaacaaucaucuccaccacgcuauugacgccgugaucauugcauaugcuaacaacucuaucgucaaagccuuuucagauuucaagaaggagcaggaaaguaauagcgcggagcuguacgccaaaaagauauccgaacuugacuauaaaaacaagcgaaaauuuuucgagccauuuucuggguucagacagaaggugcuggauaagaucgacgagauuuucguuucgaaaccggaaaggaagaaacccagcggagcuuugcaugaggaaaccuuucgcaaggaggaagaguucuaccaauccuacgguggcaaagagggggugcucaaggcacuggaacuaggaaaaauccggaaggucaauggcaagauugugaaaaacggugauauguuuagaguagacaucuucaagcacaaaaagacuaauaaauuuuaugccguuccuauauacacaauggauuucgcucugaaggugcucccaaacaaggccgucgcaaggucuaaaaagggggagauuaaagacuggauccugauggaugaaaauuaugaguuuugcuucagucuuuacaaggacucuuugauucugauccagaccaaagacaugcaggaacccgaguuuguguauuacaacgcguucacgagcuccaccgucucauuaauagugagcaagcaugauaauaaguuugagacacucucuaaaaaccagaagauccuguucaaaaaugccaacgaaaaggagguuauugcuaaauccaucggcauucaaaaucuuaagguguucgaaaaguauaucguaagugcccugggagaggucacuaaagcagaauuucgccagcgagaggacuucaagaaauga

SEQ ID NO: 2566 - RNA, 2958 nt, Artificial Sequence
  Cas9 variant
auggccaagauccuggcuuucgacauuggcauaagcuccaucgggugggcauuuguggagaacgaugaacucaaagacugcggagucagaauuuucaccaaggccgagaaucccaaaacaggugaaucucuugcgcugccuaggcgguuggcucgcucagcccgaaagcguuuagcaagaaggaaagcccggcugaaccaccuaaagcaucucaucgcuaaugaguuuaagcugaacuacgaagauuaucagaguuucgacgagagccuugcaaaagccuacaagggcacucugauuuccccauaugaguugcgcuuuaaagcucucaaugaacugcugucuaagcaagaucucgccagaguuaucuuacacauagcgaaaaggcggggguacgacaacaucaaaaauucggaugacaaggagaaaggagcaauucugaaggccgugaaagaaaacgaggagaaacuugcuaauuauaagucaguaggcgaauacuuguauaaggaguacuuccagaaauuuaaggaaaacagcaaggaguucaucaaugugcgcaacaaaaaggaaaguuacgagcgauguauugcccaguccuuucugaaagaugagcuaaagcucaucuuccagaaacaaagagaauuugguuucaauuuuucuaagaaguucgaggaagagguccugagcguggcauucuauaaaagggcucuuaaggacuuuucccaucugguugggaacugcucauucuuuguggaugaaaaacgggccccgaagaauagucccuuggcguucgaguuugucgcccucacgcguauagugaaccuguuaaacaaucugaacaaaaauaacagcuacauuaaggacgaucucaaugcacuucugucugagguauugaagaacggaacccuaacauauaaacagacuaagaaaauccugggccucuccgacgacuacgaauuuaagggccagaaagggaauuauuucauugaguucaagaaguacaaagaauuuaucaaggcucugugugagcacaaccuuaaucaggaugaccugaacgaaaucgccaaagauauuaccuugguuaaggacgagacaaaacucaagaaagcucuggccaaguaugauuuaaaucaaaaccagauagagaaucugucaaagaucgaguucaaagaccaucuaaacauuagcuuuaaggcacucaaacugaucgugccucuuaugcgcgaaggaaagaaauacgaugaagucugcaaugaguugaaccugaagaccgccauaaacgaggacaagaaagaguuccucccagcuuuuaaugaaacuuacuauaaggaugaagugaacaaucccgugguccugagagcgauuaaagaguacaggaagguucuuaacagucuguugaaaaaguaugguaaggugcacaaaaucaauaucgaacucgcacgggagguaggcaagaaccaccgagagcgcucuaaaauugaaaaggagcagaaugaaaacuucaaagccaagaaggacgcugagcuggaaugugagaaauuagggcugaagaucaauuccaaaaacauucuaaagcucagacuguucaaagagcagaaggaauuuugcguguacagcggagagaaaauaaagaucucggaucuucaagacgaaaagauguuggagauugaccauaucuauccuuacucuagguccuucgaugacucauauaugaauaaaguccugguguuuacaaagcagaaccaggaaaaacucaauaagaccccauucgaggccuuuggcaaagaugacguuaaguggcaaaagaucgagacgcuggcaaagaacuuacccgccaagaaacagaagcggauucuggauaaaaauuacaaggacaaggaacagaaagauuucaaggaccgcaaccuuaacgauacuagauacauagcuagguuggugcucaauuauaccaaagacuaccuggaguuucuaccucugagugaugacgaaaacaucaagcucaaugauacacagaaagguagcaagguccacguggaggccaaguccgggaugcugacuucuguacuucgucauaccuggggauucagcacaaaagaccggaacaaucacuugcaccaugcaauugacgcgguuaucauugcuuaugccaacgcaucaguggucaaggccuuuagugauuucaaaaaggagcaagaaaauuacaccgcugagcuguaugccaaaaagaucaacgaauuagacuuuaagaauaaacgaaaguucuuugagccauucuccaacuucagacagaaagugcucgaaaagauagaugagaucuuugucagcaaaccggagaggaagaaacccucuggcgcacugcacgaagagacguucuacaaggaagaggaauuuuauaaggaguacggcgggaaagagggagugcuuaaggcucuggaauuggguaaaauucgcaagguuaauggcaaaaucgugucaaacgccaauauguuccggguagacauuuuuaaguacaagaaaacuaacaaguucuaugcggucccuaucuacacaauggauuuugcccucgggauacugccaaauaaagcugugguuggaggcaaggacaaacaggguauuaucaaggauuggcuacugauggacgagaacuaugaguucuguuuuagucucuacaaggauagccugauucuuuugcagaccaaagacaugcaagaacccgaacugguguauuucaaguccuuuaaaucuucgacugcaggguuagucgugagcaagcaugauaacaaauucgagaaucucaacgagaaucagaagaagcuguucaaauccgccaacgaaaagaaaguaguggcugagggcaucggaauacagaaucuuaagguuuuugaaaaauacaucgucucagcccugggcgagauuacaaaggcagagaucaaagaaagagagaacuucaagaagaaauga

SEQ ID NO: 2567 - RNA, 2961 nt, Artificial Sequence
  Cas9 variant
augcccagcgacccugccgaggcuaagccacuggaacuccuugauccguacgcacugagagcccagggcuuggaccaagcguuaccccugacccacuucgggagggcucuauuucaucucaaccagcggcgcggauucaaauccaaucgaaagacagaucguggugacaacgagaauggcaaaaucaaggaugccucucagagacuggacugggcaaugcacgaagccaaagcuaggacuuauggggaguuucuucaucugcggcgccagaaggcaccugauccaagacaagugcccacggucaggacccgguugucaguuggaaagcgcggcgguccugacgccaaagaagaggcuggguacgauuucuauccagaccgaagacaccucgaggaagaguuucaugaacuguggagugcccaggcgcaguuccaccccgagcugacacaggaucucagggacuuaguguuugagaagauuuucuaccaacggccucugaaagaaccaaagguaggacuuugcuuguuuacuagcgaggaacgucuggcaaaagcccacccgcuaacccagcgcagagugcucuaugagacagucaaccagcugaggauaaccgcugauggccgguccgugcgaccccuuucucgcgaacagagagaccaaaucauucuggccuuggacacuaagaagccuacaaaaucgcucaauucaaugguugugacccugcaggcauuaggcaagguccugaaacucagggagggggagcgguucacgcuugaaagcggagugcgcgaggcuaucgccugugauccaguaagagcggccaugcuggcaacuuuuggucccagguggagugcuuuggacuggccugaacaguggcaaguuauuucccgugugcggaagcuacaggaugacaaagauuucgccgagcuggucgaauggcucaucgagcuguacggcguggacaaggaggcugccgugaaaauagcaaacacccaucuuccagaaggguauggacgacugggcuugacagccacuaccagaauccucgauaggcugaagucuaaugucuuuacauacgcucaggcgguugcagccugcgguuggcaccauagcgaccagcgcaccggggaguguuuagaucggcugcccuacuauggagcugugcuagacagacacguaauuccgggcacguacgaugaaaacgacgacgauaucacuagguucggccgcauuacaaauccuaccgugcacaucgggcucaaccaacugcgacggcuugucaauaagauaauugagguguauggaaaacccaaccagaucguuguggaauuggcccgugagcugaagcaguccgagcagcagaaaaaugacgcaauuaagcucaucagagauacuacaaccgccgcuaaacagaggucagaaaagcuggaggaacuugguaucacggacaacggccgcaaucggaugcuguugagacucugggaggaucugaacccagacgaugccaugaggcgauucugcccuuacaccgggcagcgcauuagugcagcgaugauauuugacggaagcugugaugucgaccauaucuuacccuauucucggacacuggaugacggcuucgcuaacagaacucuaugccucagggaggccaaucgugaaaagcgcaaccagaccccaugggaggcauggggugggacacccaauugggaagccauugagacuaaccugaaaaaucuuccugaaaacaagcgguggagauuugcuccagaugccauggcaagguucgagggcgagaaugacuuuuuggaccgagcucugguggauacccaauaccucgcccggaucucccgcacauaucuggacaccuuauucacugaaggaggccacguauggguugugccggggagacugacggagaugcuuaggcggcauuggggauugaacucacuccugacagauaaagaccgaggugcggucaagagcaaaaauagaaccgaucaccgccaucacaguauagacgccgcuguggucgcagccacugauaggucucuacugaaccguauuucccgggcugccggccagggggaaguggcaggacagagcgcggagcucaucgccagagaaacacccccuccaugggagggcuuuaggaaugaccugaagucgcagcuuggucgcaucauuguuucucaccgagcugaucaugggagaaucgaccggcaagccaggaagcagggccgcgauuccaccgcaggacaguugcaccaagagaccgcuuacucaauuguggacgauacucguguagccaguagaauagacuuccugagcgucaaacccgcacaguuacucgaccagccuggccgguccgggcaagugagggaucugcaacuucgcaaggcccugcgaguugcuacaggagacuugacggguaaagauuacgaaaaggcgcucagagacuuugccgcaaaaccaggccccuauaaggggauccggagggugcgcauuaucaagccgcugcaggagcaggcuagagucccugugccaguacuagaucccaucaaagccuaccagggaggcucuaaccauguguucgaaauuuggcaucugccugacgguaagguugagccccaagucauaaccagcuuugaagcccacgcucucgagguggagaaaaggccacacccugcagccaagcggcugcuucgugugcacaaaggggauauggucgcguugaagcgcgaaggccgaacuguugugggacaugugcagcagaugcacaucaaaaauggccuguucauuguaccccauaacgaggcuaaugccgacgcaagaaacucagauaggacagacccauuuaaguggauccagauugccgcucaaccggcaaucgccgcggggauacggcgcgucgcuguggaugaaaucggaagauuaagggacggcggugccaagaccauuuga

SEQ ID NO: 2568 - RNA, 2964 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuugagucgaagcgcucguaaaagauuagccaggcggaaggcacgccugaaccaccuaaaacaucucaucgccaaugaguuuaagcugaacuacgaagauuaucaguccuucgacgagucucuugcuaaggcauacaaaggcucgcugauuucaccauaugaguugagauuuagggcccucaaugaguuccugagcaagcaagauuuugcucgggucauccugcacauagccaaacgccgaggguacgacgauaucaagaacaauggagacgaggaaaaaggcgagauucucaaggcgaucaagcagaacgaggaaaaauuaguuaguuaucaguccgugggugaguaccuguauaaggaauacuuccagaaauuuaaggaaaauucuaaagaguucauuaacguaagaaauaagaaagaaagcuacgagagguguaucgcacaauccuuucuuaaggaugaauugaagcugauauuccagaaacagcgggaguuuggguucucauucaguaagaaauuugaagaggaagugcuaagcgucgccuucuauaagcgugcucucaaagacuuuucucaucuggugggaaacugcuccuucuuuacugaugagaagcgcgccccgaaaaauucaccccuugcauucauguuuguugcucugacgagaauuaucaacuugcucaauaaccugaaaaacaccgagggcauuuuauacacaaaggacgaucugaauacucuccuuaacgaagugcugaaaaauggcaccuugacauauaagcagaccaaaaagcuacuggggcucagcaacgacuacgaguucaagggagaaaaagguacuuauuuuaucgaguuccaaaaguacaaagaauuugucaaggcccugggcgagcacaaucuuagucaggacgaucugaacgagaucgcgaaagacauuacauugauaaaggaugaaaucaagcucaaaaaggcccuggcaaaauaugacuuaaaucagaaccagauugauucucuguccaagcuagaguucaaagaccaucucaauaucagcuuuaaggcucugaaacuuauaaccccuuugaugcuggaagggaagaaguacgaugaggccuguaacgagcucaaucugaaaguggcuauuaacgaagacaagaaagauuuccuuccagccuucaaugagacguacuauaaggacgaaguaacuaaccccguugugcugagggcaaucaaagaguaccggaaggucuugaaugcccuccugaagaaauauggaaaggugcacaaaaucaacauugaauuagcucgagaggugggcaagaaccacucgcaacgcgcgaaaaucgagaaggaacagaaugagaacuacaaggcaaagaaggaugccgaacuggagugcgaaaaacuaggucucaagauuaauucuaaaaacauacugaaacuuagauuguuuaaggagcagaaagaguucugugucuauuccggggaaaagaucaaaauuucagaccugcaagacgagaagaugcucgaaaucgaucauaucuacccuuauaguaggagcuuugacgauuccuacaugaauaaaguucugguguucaccaagcagaaccaggagaaauuaaauaagacaccauuugaaacuuucggaaacgaccggguaaaguggcagaaaauugaggugcuggcuaagaaucuucccaccaaaaagcaaaaacgcauauuggauaagaacuacaaggacaaagagcagaaggauuuuaaagacagaaaucucaacgauacaagguauaucgcccgucugguccuaaauuacaccaaggacuaucuggauuuccucccucugucugacgaugaaaacacgaaacuuaaugacacucagaagggcagcaaggugcacguugaggcaaaaucaggcauguugacaaguacccugcggcauacuuggggguuuuccacaaaggaccgagauaaccacuuacaccaugccauugacgcugccaucauugcauacgcgaacaauagcaucgugaaggcuuucucugauuuuaagaaagaacaggagucaaacaccgccgagcucuaugcaaagaagauaagugaacuggacuacaaaaauaagagaaaauucuuugagccauucagcggauucaggcaaaaacuucuggauaagaucgacgaaauuuuugucuccaagccggagcgcaagaaacccucuggugccuugcacgaagagacguuccggaaggaggaagaguuuuaucagucguacggcgggaaagaaggagugcucaaggcucuggagcuaggcaaaaucagaaagguaaacgguaaaaugguuaagaauggggauauguucaggguggacauuuuuaagcauaaaaagaccaacaaauucuacgccgucccuaucuauacaauggauuuugcacugaaggugcucccaaauaaagcugucgugcagggcaaggacaagaaaagcggacugauaaaggauuggauucuuauggacgaaaacuacgaguucugcuuuuccuuguauaaagauucacugaucuuaauucagacuaaggacaugcaagagcccgaacucguuuacuaugagcgccuggacaguucuaaugccagccuuaccguguccaaacacgauaacaaguucgaaacacugucaaagaaucagaaaauccuauuuaagaacgcgaaugagaaagaaguaauagccaagagcaucggcauucagaaccucaaagucuucgagaaguacaucgugucugcucugggggagguuacuaaggcagaguuccgacagcgggaagacuuuaaaaaguga

SEQ ID NO: 2569 - RNA, 2964 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaaccaccuaaaacaucucaucgcuaaugaguuuaagcugaacuacgaagauuaucagagcuucgacgagucccuugcaaaggccuacaaaggcucucugauuucgccauaugaguugagauuuagggcucucaaugaacugcugucaaagcaagauuucgcccgggucauccuccacauagcgaaacgccgaggguacgacgauaucaagaacagcgacgauaaagagaagggagcaauuuuaaaggccaucaaacagaaugaagagaagcuggcuaacuaucagaguguuggcgaguaccuuuauaaagaauacuuucagaaguucaaagaaaauuccaaggaauuuacuaacgugagaaauaaaaaggagucuuacgaaagguguauugcccagagcuucuugaaggacgagcugaaacuaaucuuuaagaaacaacgggaguucgguuuuuccuucucaaagaaauucgaagaggaaguacucaguguggcauuuuauaagcgugcucugaaggauuucagccaucuugucgggaacugcucauuuuucacggacgagaaacgcgccccgaaaaauucccccuuagcguuuauguucguggccuugaccagaauaauuaaccuccugaauaaccugaaaaacacagaaggaauccuguacacuaaggaugaccucaaugcacuucugaacgagguuuugaaaaauggcacccuaacauauaagcagaccaagaaacugcucggccugucagacgauuacgaguuuaagggggaaaaaggaacuuauuucauugaguuuaagaaauacaaggaguucaucaaggcucuuggugaccacagccugagucaggaugacuugaacgagaucgccaaagauauuacacucauaaaggacgaaaucaaacugaagaaggcuuuagccaaguaugaucugaaucaaaaccagauugacucucuauccaaacucgaguuuaaggaucaucugaauaucagcuucaaggcacuuaaauugauaaccccucugaugcucgagggcaagaaauacgacgaagccuguaacgagcugaaucuuaagguggcuauuaacgaagauaaaaaggacuuucugccagcguucaaugagacguacuauaaggacgaggucacuaaccccgugguauugagggcaaucaaagaauaccggaagguucucaaugcccugcugaaaaaguaugggaaagugcacaagaucaacauugaguuagcucgagaagucggaaagaauuacucgcagcgcgccaaaaucgagaaggaacagaacgagaacuauaaagcaaagaaagaugccgagcuagaaugcgagaagcucggccugaagauuaauucuaaaaacauacuuaaguugagacuguucaaagaacaaaaggaguuuugugcuuacuccggugaaaagaucaaaauuucagaccuccaggaugagaaaaugcuggagaucgaccacaucuauccuuacaguaggagcuucgaugacuccuacaugaauaagguguuaguguuuaccaagcagaaccaagaaaaacugaaucagacaccauucgaggccuuugggaacgauucugcaaaguggcagaaaauugaaguccuugcgaagaauuugcccacuaaaaagcagaagcggauacucgacaaaaacuauaaggauaaagagcaaaaggacuucaaagaucgcaaucugaacgacaccagauacaucgcuaggcuaguucugaauuauacaaaggauuaccucgacuuucugccucuuagcgacgaugaaaacaccaaguugaaugacacgcagaaaggaucaaaggugcauguagaggccaaaaguggcaugcugacuuccgcauuacgucacacauggggcuucagcgccaaggaucggaacaaucaucuccaccacgcuauugacgccgugaucauugcauaugcuaacaacucuaucgucaaagccuuuucagauuucaagaaggagcaggaaaguaauagcgcggagcuguacgccaaaaagauauccgaacuugacuauaaaaacaagcgaaaauuuuucgagccauuuucuggguucagacagaaggugcuggauaagaucgacgagauuuucguuucgaaaccggaaaggaagaaacccagcggagcuuugcaugaggaaaccuuucgcaaggaggaagaguucuaccaauccuacgguggcaaagagggggugcucaaggcacuggaacuaggaaaaauccggaaggucaauggcaagauugugaaaaacggugauauguuuagaguagacaucuucaagcacaaaaagacuaauaaauuuuaugccguuccuauauacacaauggauuucgcucugaaggugcucccaaacaaggccgucgcaaggucuaaaaagggggagauuaaagacuggauccugauggaugaaaauuaugaguuuugcuucagucuuuacaaggacucuuugauucugauccagaccaaagacaugcaggaacccgaguuaguguauuuuaacgcguucacgagcuccaccgucucacucauagugagcaagcaugauaauaaguuugagacacugucuaaaaaccagaagauccuuuucaaaaaugccaacgaaaaggagguuauugcuaaauccaucggcauucaaaaucugaagguguucgaaaaguacaucguaagugcccuaggagaggucacuaaagcagaauuucgccagcgagaggacuucaagaacgagcuccgguga

SEQ ID NO: 2570 - RNA, 2964 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaaccaccuaaaacaucucaucgcuaaugaguuuaagcugaacuacgaagauuaucagagcuucgacgagucccuugcaaaggccuacaaaggcucucugauuucgccauaugaguugagauuuagggcucucaaugaacugcugucaaagcaagauuucgcccgggucauccuccacauagcgaaacgccgaggguacgacgauaucaagaacaauggagacgaggaaaaaucagagauuuuaaaggcaaucaagcagaacgaggaaaaacugguuaauuaucagagugugggcgaguaccuuuauaaggaauacuuucagaaauucaaggagaacuccaaagaauuuauuaauguaagaaacaagaaagagucuuacgagagguguaucgcccaaucuuucuugaaggaugaacugaagcuaauauuucagaaacagcgggaguucgguuuuuccuucucaaagaaauucgaagaggaagugcucagugucgcuuuuuauaagcgugcccugaaagacuucagccaucuuguggggaauugcagcuuuuucacugaugagaagcgcgcaccgaagaacucccccuuaguuuuuauguucguggcuuugacgagaauuaucaaucuccugaacaaccugaaaaauaccgagggcauucuguacacaaaggacgaucucaacgcccuucugaaugaagucuugaaaaacggaacucuaaccuauaagcagacaaagaagcugcucggccugucagacgacuacgaguuuaagggggaaaaaggaaccuauuucaucgaguuuaagaaauacaaggaguucaucaaagcgcuugaugaacacagccugagucaagacgauuugaaugagauugccaaggacauaacucucaucaaggaugaaauuaaacugaagaaagcauuagcuaaguaugaccugaaagagaaccagaucgauucucuauccaagcucgaauuuaaagaccaucugaauauuagcuucaaggcccuuaaguugauaacaccucugaugcucgaggguaaaaaguacgaugaggcuuguaacgaacugaaucuuaaaguggccaucaacgaggacaagaaagauuuucugccagcauucaaugaaaccuacuauaaggacgagguaacgaaccccguuguguugagggccaucaaggaauaccggaaaauucucaaugcucuguuaaagaaauauggcaagguccacaaaaucaacauugagcuggcgcgagagguggggaagaaucacucgcagcgcgcaaagauagaaaaagagcagaacgaaaacuacaaggccaaaaaggacgcugagcuagaaugcgagaaacucggacugaagaucaauucuaagaacauucuuaaauugagacuguucaaggagcaaaaagaauuuuguguguauuccggcgagaagaucaaacucucagaucugcaggacgaaaagauguuagagaucgaucauauuuacccuuauaguaggagcuucgacgauuccuacaugaauaaaguccugguuuuugccaagcagaaccaagaaaaacuuaauaaaacuccauucgaggcauuugguaacgacucuaccaaguggcagaaaauagagguguugacaaagaaucuccccacuaaaaagcagaagcggauccuggauaaaaacuacaaggacaaagaacagaaggauuucaaagaccgcaaucuaaacgauaccagauauauugccaggcugguacucaauuacacaaaggacuaucuggauuuucuuccuuugagcgacgacgagaacaccaagcugaaugauacgcaaaaagggucaaaggugcacgucgaagcuaaaaguggaauguuaacuuccgcccuccgucauacauggggcuucagcaccaaggaccggaacaaucaucugcaccacgcaaucgaugcggugauuaucgcuuacgccaacaacucuauaguuaaagcauuuucagacuucaagaaggagcaggagaguaauagcgccgaacuuuaugcuaaaaagaucuccgagcuggauuacaaaaacaagcgaaaauuuuucgaaccauuuucuggcuucagacagaagguguuggacaagauugaugagaucuucgucucgaaaccggaaaggaagaaacccagcggggcccuccacgaggagacuuuucgcaaggaagaggaguucuaucaguccuacggagguaaagaaggcgugcugaaggcacuagaacuggggaaaauucggaagguaaauggaaagaucguuaaaaacggcgacauguuuagaguggauauauucaagcauaaaaagacaaauaaauuuuacgcugucccuauuuauaccauggacuucgcccucaaggugcugccaaacaaggcggucgccaggagcaaaaagggugagaucaaagauuggauucuuauggacgagaauuacgaauuuugcuucaguuuguauaaggauucucugaucuuaauacaaacgaaagacaugcaggagcccgaacucguguacuuuaacgcuuucaccagcuccacaguuucacugaucgugagcaagcacgacaauaaguuugagacucuuucuaaaaaccagaagauucuguucaaaaaugcaaacgaaaaggagguaaucgccaaauccauugggauccagaaucuaaaggucuucgagaaguauauagugagugcucucggcgaaguuaccaaagccgaguuucgccaacgagaagauuucaagaacgagcugcgguga

SEQ ID NO: 2571 - RNA, 2964 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaaccaccuaaaacaucucaucgcuaaugaguuuaagcugaacuacgaagauuaucagagcuucgacgagucccuugcaaaggccuacaaaggcucucugauuucgccauaugaguugagauuuagggcucucaaugaacugcugucaaagcaagauuucgcccgggucauccuccacauagcgaaacgccgaggguacgacgauaucaagaacagcgacgauaaagagaagggagcaauuuuaaaggccaucaaacagaaugaagagaagcuggcuaacuaucagaguguuggcgaguaccuuuauaaagaauacuuucagaaguucaaagaaaauuccaaggaauuuacuaacgugagaaauaaaaaggagucuuacgaaagguguauugcccaauccuucuugaaggacgagcugaaacuaaucuuuaagaaacagcgggaguucgguuuuuccuucucaaagaaauucgaagaggaaguacucaguguggcauuuuauaagcgugcucugaaggauuucagccaucuugucgggaacugcucauuuuucacggacgagaaacgcgccccgaagaauagcccccuggcguuuauguucguggccuugaccagaauaauuaaccuccugaauaaccugaaaaacacagaaggaaucuuauacacuaaggaugaccucaauacccuucugaacgagguuuugaaaaauggcacacuaaccuauaagcagacuaagaaacugcucggccugucugacgauuacgaguuuaagggggaaaaaggaacauauuucauugaguuuaagaaauacaaggaguucaucaaggcacuuggugagcacaaccugagccaggacgauuugaaugaaaucgcuaaagacauuacccucauaaaggaugagaucaaacugaagaaagccuuagcuaaguaugaccugaaccaaaaucagauugauagucuaucuaaacucgaguuuaaggaccaucugaacaucuccuucaaggcccuuaaauuggugacgccucugaugcucgaaggcaagaaauacgaugaggcauguaaugaacugaaccuuaaggucgccauaaaugaggacaaaaaggauuuucugccagcuuucaacgagacuuacuauaaggacgaagugaccaaucccguaguuuugagggcgauuaaagaguaccggaaggugcucaacgcacugcugaaaaaguaugggaaaguccacaagaucaauaucgaauuagcccgagaggugggaaagaaccacagccagcgcgcuaaaauugaaaaggagcagaacgagaauuacaaagccaagaaagacgcagaacuagagugcgaaaagcucggccugaagaucaacucgaaaaauauucuuaaguugagacuguucaaagagcaaaaggaauuuugugccuauucuggugagaaaauaaagaucuccgaucuccaggacgagaaaaugcuggaaauugaucauaucuacccuuauucaaggaguuucgacgauagcuacaugaacaagguguuagucuuuacaaagcagaaucaagagaaacugaaccagacuccauucgaggcuuuugggaaugacuccgccaaguggcagaaaaucgaaguucuugcaaagaacuugcccaccaaaaagcagaagcggauucucgauaaaaauuacaaggacaaagaacaaaagaacuucaaagaucgcaaucugaacgacacaagauauauagcgaggcuagugcugaauuacaccaaggauuaucucgacuuucugccucuuucugaugacgagaacacgaaguugaaugacacucagaaaggaagcaagguacacguggaggcuaaaucaggcaugcugacaagugccuuacgucauaccuggggcuucuccgcaaaggaucggaacaaccaccuccaccaugccaucgacgcugucauuaucgccuacgcaaauaacagcauugugaaggcuuuuucugauuucaaaaaggaacaggagucaaauagugccgaacuguaugcgaaaaagaucagcgagcuugacuacaaaaacaagcgaaaauuuuucgagccauuuuccggguucagacagaagguucuggauaagauagacgaaaucuucgugucuaaaccggagaggaagaaacccucgggagccuugcacgaagagacuuuucgcaaggaagaggaguucuaucaaagcuacgguggcaaagaagggguccucaaggcucuggagcuaggaaaaauucggaaggugaauggcaagaucguuaaaaacggugauauguuuagaguagacauuuucaagcauaaaaagacaaauaaauuuuacgcagugccuaucuauaccauggauuucgcccugaagguccucccaaacaaggcuguggccagguccaaaaagggggaaauaaaagacuggauucugauggaugagaauuacgaauuuugcuucucacuuuauaaggacaguuugauccugauucagacgaaagauaugcaggagcccgaguuagucuacuuuaacgcauucaccucuagcacagugucccucaucguuucaaagcacgacaauaaguuugaaacucugagcaaaaaccagaagauacuuuucaaaaaugcgaacgagaaggaagugaucgccaaaucuauuggcauccaaaaucugaagguauucgagaaguauauugucuccgcucuaggagaagugaccaaagccgaguuucgccagcgagaggacuucaagaacgaacuccgguga

SEQ ID NO: 2572 - RNA, 2964 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaaccaccuaaaacaucucaucgcuaaugaguuuaagcugaacuacgaagauuaucagagcuucgacgagucccuugcaaaggccuacaaaggcucucugauuucgccauaugaguugagauuuagggcucucaaugaacugcugucaaagcaagauuucgcccgggucauccuccacauagcgaaacgccgaggguacgacgauaucaagaacagcgacgauaaagagaagggagcaauuuuaaaggccaucaaacagaaugaagagaagcuggcuaacuaucagaguguuggcgaguaccuuuauaaagaauacuuucagaaguucaaagaaaauuccaaggaauuuacuaacgugagaaauaaaaaggagucuuacgaaagguguauugcccaaucuuucuugaaggacgagcugaaacuaaucuuuaagaaacagcgggaguucgguuuuuccuucucaaagaaauucgaagaggaaguacucaguguggcauuuuauaagcgugcucugaaggauuucagccaucuugucgggaacugcagcuuuuucacggacgagaaacgcgccccgaaaaauucccccuuagcguuuauguucguggccuugaccagaauaauuaaccuccugaauaaccugaaaaacacagaaggaauccuguacacuaaggaugaccucaaugcacuucugaacgagguuuugaaaaauucaacccuaacauauaagcagaccaagaaacugcucggccugagcgacgauuacgaguuuaagggcgaaaaagggacuuauuucauugaguuuaagaaauacaaggaguucaucaaggcucuuggagaccacagucugucucaggaugacuugaacgagaucgccaaagauauuacacucauaaaggacgaaaucaaacugaagaaggcuuuagccaaguaugaucugaaucaaaaccagauugacucccuaagcaaacucgaguuuaaggaucaucugaauaucucguucaaggcacuuaaauugauaaccccucugaugcucgaggguaagaaauacgacgaagccuguaacgagcugaaucuuaagguggcuauuaacgaagauaaaaaggacuuucugccagcguucaaugagacguacuauaaggacgaggucacuaaccccgugguauugagggcaaucaaagaauaccggaagguucucaaugcccugcugaaaaaguauggcaaagugcacaagaucaacauugaguuagcucgagaagucgggaagaauuacucucagcgcgccaaaaucgagaaggaacagaacgagaacuauaaagcaaagaaagaugccgagcuagaaugcgagaagcucggacugaagauuaauuccaaaaacauacuuaaguugagacuguucaaagaacaaaaggaguuuugugcuuacucaggcgaaaagaucaaaauuagugaccuccaggaugagaaaaugcuggagaucgaccacaucuauccuuacagcagguccuucgaugacucuuacaugaauaagguguuaguguuuaccaagcagaaccaagaaaaacugaauaagacaccauucgaggccuuugguaacgauagcgcaaaauggcagaagauugaaguccuugcgaaaaauuugcccacuaagaagcagaaacggauacucgacaagaacuauaaagauaaggagcagaaagacuucaaggaucgcaaucugaacgacaccagauacaucgcuaggcuaguucugaauuauacaaaggauuaccucgacuuucugccucuuucagacgaugaaaacaccaaauugaaugacacgcaaaaggggaguaaagugcauguagaggccaaguccggaaugcugacuagcgcauuacgucacacauggggcuucucugccaaagaucggaacaaucaucuccaccacgcuauugacgccgugaucauugcauaugcuaacaacucaaucgucaaggccuuuagugauuucaagaaagagcaggaaagcaauuccgcggagcuguacgccaagaaaauaucugaacuugacuauaagaacaaacgaaaguuuuucgagccauuuucgggcuucagacagaaggugcuggauaaaaucgacgagauuuucguuagcaagccggaaaggaaaaagcccuccggggcuuugcaugaggaaaccuuucgcaaagaggaagaguucuaccagucauacggagguaaggagggcgugcucaaagcacuggaacuagggaagauccggaaggucaauggaaaaauugugaagaacggcgauauguuuagaguagacaucuucaaacacaagaaaacuaauaaguuuuaugccguuccuauauacacaauggauuucgcucugaaggugcucccaaacaaagccgucgcaaggaguaagaaaggugagauuaaggacuggauccugauggaugaaaauuaugaguuuugcuucucucuuuacaaagacagcuugauucugauccaaaccaaggacaugcaggaacccgaguuaguguauuuuaacgcguucacguccucaaccgucagccucauagugucuaagcaugauaauaaauuugagacacuguccaagaaccagaaaauccuuuucaagaaugccaacgaaaaagagguuauugcuaagaguaucgggauucagaaucugaagguguucgaaaaauacaucguaagcgcccuaggcgaggucacuaaggcagaauuucgccaacgagaggacuucaaaaacgagcuccgguga

SEQ ID NO: 2573 - RNA, 2964 nt, Artificial Sequence
  Cas9 variant
auggccagaauccuggcuuucgacauuggcauaagcuccaucgggugggcauuuucugagaacgaugaacucaaggacugcggagugaggauuuucaccaaagccgagaaucccaagacaggugaaucacuugcgcugccucggcgcuuggcucgaagugcccguaaaagauuagcaaggcggaaggcccgccugaaccaccuaaaacaucucaucgcuaaugaguuuaagcugaacuacgaagauuaucagagcuucgacgagucccuugcaaaggccuacaaaggcucucugauuucgccauaugaguugagauuuagggcucucaaugaacugcugucaaagcaagauuucgcccgggucauccuccacauagcgaaacgccgaggguacgacgauaucaagaacagcgacgauaaagagaagggagcaauuuuaaaggccaucaaacagaaugaagagaagcuggcuaacuaucagaguguuggcgaguaccuuuauaaagaauacuuucagaaguucaaagaaaauuccaaggaauuuacuaacgugagaaauaaaaaggagucuuacgaaagguguauugcccagagcuucuugaaggacgagcugaaacuaaucuuuaagaaacaacgggaguucgguuuuuccuucucaaagaaauucgaagaggaaguacucaguguggcauuuuauaagcgugcucugaaggauuucagccaucuugucgggaacugcucauuuuucacggacgagaaacgcgccccgaaaaauucccccuuagcguuuauguucguggccuugaccagaauaauuaaccuccugaauaaccugaaaaacacagaaggaauccuguacacuaaggaugaccucaaugcacuucugaacgagguuuugaaaaauggcacccuaacauauaagcagaccaagaaacugcucggccugucagacgauuacgaguuuaagggggaaaaaggaacuuauuucauugaguuuaagaaauacaaggaguucaucaaggcucuuggugaccacagccugagucaggaugacuugaacgagaucgccaaagauauuacacucauaaaggacgaaaucaaacugaagaaggcuuuagccaaguaugaucugaaucaaaaccagauugacucucuauccaaacucgaguuuaaggaucaucugaauaucagcuucaaggcacuuaaauugauaaccccucugaugcucgagggcaagaaauacgacgaagccuguaacgagcugaaucuuaagguggcuauuaacgaagauaaaaaggacuuucugccagcguucaaugagacguacuauaaggacgaggucacuaaccccgugguauugagggcaaucaaagaauaccggaagguucucaaugcccugcugaaaaaguaugggaaagugcacaagaucaacauugaguuagcucgagaagucggaaagaauuacucgcagcgcgccaaaaucgagaaggaacagaacgagaacuauaaagcaaagaaagaugccgagcuagaaugcgagaagcucggccugaagauuaauucuaaaaacauacuuaaguugagacuguucaaagaacaaaaggaguuuugugcuuacuccggugaaaagaucaaaauuucagaccuccaggaugagaaaaugcuggagaucgaccacaucuauccuuacaguaggagcuucgaugacuccuacaugaauaagguguuaguguuuaccaagcagaaccaagaaaaacugaaucagacaccauucgaggccuuugggaacgauucugcaaaguggcagaaaauugaaguccuugcgaagaauuugcccacuaaaaagcagaagcggauacucgacaaaaacuauaaggauaaagagcaaaaggacuucaaagaucgcaaucugaacgacaccagauacaucgcuaggcuaguucugaauuauacaaaggauuaccucgacuuucugccucuuagcgacgaugaaaacaccaaguugaaugacacgcagaaaggaucaaaggugcauguagaggccaaaaguggcaugcugacuuccgcauuacgucacacauggggcuucagcgccaaggaucggaacaaucaucuccaccacgcuauugacgccgugaucauugcauaugcuaacaacucuaucgucaaagccuuuucagauuucaagaaggagcaggaaaguaauagcgcggagcuguacgccaaaaagauauccgaacuugacuauaaaaacaagcgaaaauuuuucgagccauuuucuggguucagacagaaggugcuggauaagaucgacgagauuuucguuucgaaaccggaaaggaagaaacccagcggagcuuugcaugaggaaaccuuucgcaaggaggaagaguucuaccaauccuacgguggcaaagagggggugcucaaggcacuggaacuaggaaaaauccggaaggucaauggcaagauugugaaaaacggugauauguuuagaguagacaucuucaagcacaaaaagacuaauaaauuuuaugccguuccuauauacacaauggauuucgcucugaaggugcucccaaacaaggccgucgcaaggucuaaaaagggggagauuaaagacuggauccugauggaugaaaauuaugaguuuugcuucagucuuuacaaggacucuuugauucugauccagaccaaagacaugcaggaacccgaguuuguguauuacaacgcguucacgagcuccaccgucucauuaauagugagcaagcaugauaauaaguuugagacacucucuaaaaaccagaagauccuguucaaaaaugccaacgaaaaggagguuauugcuaaauccaucggcauucaaaaucuuaagguguucgaaaaguauaucguaagugcccugggagaggucacuaaagcagaauuucgccagcgagaggacuucaagaacgagcuacgguga

SEQ ID NO: 2574 - RNA, 2979 nt, Artificial Sequence
  Cas9 variant
augagaaucuucagcgacggcaggaaccccaaggauggguccucucuggccgugacccggcgcgcugcacgagccaugcguagaaggcgggaccgccuccuuaaaagaaagacaaggaugcaggcgaaacuggucgagcacggauuuuucccugcugaugccgguaagcggaaagcauuggaacaauuaaauccauacgcccugcgcgcuaagggccuacaggaggcacuccugccgggggaauuugcccgagcucuuuuccauauuaaccagagaaggggauuuaagucaaaucggaaaacugacaagaaagauaacgacaguggcguucugaagaaagccauaggucaguugcgucaacagauggcggagcaggggagccgcacggugggagaauaucucuggaccagacugcagcaaggccagggcguaagggcacgguaccgagagaagcccuauacaacugaggaagggaagaaacgcaucgauaaguccuacgaccuguauauugauagagccaugaucgagcaggaguucgacgcucucugggccgcacaggcugccuuuaauccuaccuuauuccacgaagcggccagggcagaucugaaagacacacuuuugcaucaacggccacugcgccccgugaagccuggaagaugcacccuacucccagaggaagagagggcuccccuggcccuuccuucuacucagcguuuucggauucaccaggaagucaaccaucugcgauugcucgaugagaaucugagagaaguggcuuuaacacuggcccaaagggacgcaguugugaccgcccucgagacgaaagcuaaacuuucguucgagcagauccgcaaacuguugaagcuaucagguagcguccaguuuaaccuggaagacgcgaagcggacugagcucaaaggcaaugcaaccagugccgcucuggccagaaaggaacuuuucggggcagccugguccggauuugaugaggcucugcaggacgaaauaguguggcaauugguaacagaggagggcgaaggugcccucaucgcauggcugcagacucacaccgggguugaugaggcgagggcucaggccauuguggacgucucuuuaccagaaggauacggcaaccugagccgcaaagcacuagcccgaaucgugccggcucuccgggccgcagugauuacauaugauaaggcuguccaggccgcgggcuucgaccaccauucccaacugggguucgaguacgaugccucagaaguugaggaccuugugcaccccgagaccggagaaauccguaguguauuuaaacaguugccuuacuaugguaaggcucugcagagacauguggcauucggcagcgggaagccagaggaucccgacgaaaagagguacggaaagauagccaauccuacgguccacauuggccucaaccaggugcgcaugguugugaaugcucugauccggagauaugguaggccaacugaggucgugauugagcuugcccgagaucugaaacaaucucgcgaacagaagguagaggcacagcggagacaggcggacaaccaaaggcguaaugcccgcauccggagauccaucgcugaaguuuuggggauuggcgaggaaagggugcgaggaucagacauacagaaauggaucuguugggaggagcucagcuuugaugccgcagaccggcgcugccccuacaguggcguccagauuucugcugccaugcuguuauccgaugaaguggaggucgaacacauccugccguucagcaagacacuagacgauucgcucaacaacagaaccguggcaaugaggcaagccaaucggauaaagcgaaacagaacuccuugggacgcucgcgcggaguuugaagcccagggguggucuuaugaggauauucugcagagggcagagcguaugccccuucggaaaagauacagguucgcuccagacggauaugaacgcugguugggugaugacaaggauuuucuggcccgagcccucaaugacacaagauaccugucccggguugcugcagaguacuuaaggcugguguguccuggcacccgcguaauccccgggcagcuuacggccuugcuccguggaaaauucggccugaacgauguccuaggucuggacggggaaaagaauagaaacgaccaucggcaccaugcgguggaugcuugcguuaucggcgugaccgaccaaggacucaugcagagguuugccacagcaucagcccaggcucgcggcgaugggcugacucgacuugucgacggaaugccaaugcccuggccuaccuauagagaucacguggagcgggcaguaaggcauauuugggugagucaccgcccagaccacgguuucgaaggcgccaugauggaggagacaagcuacgggaucagaaaagauggauccauuaagcagaggcggaaggcggacggcucugcuggucgugaaauaagcaauuugauccgcauucaugaggccacucaaccgcugcgacacgggguuucagcagauggccagcccuuagccuauaaaggauacgucggcgggaguaacuauuguaucgaaaucaccgugaaugacaagggaaaaugggagggcgaggugauuuccacauuuagagcuuacggugucguuagggccgggggaaugggccggcuccgcaacccucaugaaggucagaauggcagaaagcugauaaugaggcuugugaucggggauagcgugcggcuggagguagacggagcagaacgaaccaugagaauugucaaaaucucuggcucaaacgggcagauuuucauggcuccaauccacgaggccaauguggaugcgcgcaacacugacaagcaagacgccuuuacguauacaaguaaauacgcaggcagcuugcagaaggcuaagaccaggcggguuacuauaucccccaucggagaagugcgugauccugguuucaaaggguga

SEQ ID NO: 2575 - RNA, 2985 nt, Artificial Sequence
  Cas9 variant
augacccugggccucgaccuugggacaaacagcaucggaugggcccugauugauuucgacgauaaucagcaacccagaaacuugauagcuugcgguuccaggaucuuucaggaggcaguggaagccaagacuggcacgccuaaaaaucacgcgcggcgcaccgcucgagccgcacguaaguuagucgccagaaggaaacagcggcgcacaaagcugcuaaaccuccugauuagacaugggcuucugccacaggacguugcugagaggaaugcauugcuccuggauaaccaagccaauaacccguaccagcugcggaaacgcggacucgacgaaaaguuagagcccuucgcuuuuggccgagcccuguaucaccuugcgcauagaagggguuuccagucuaaucggaaggcagccucagaugaagacgggaaagugaagacugcuaucaguaccuugcgugccgagaugcagggacgcacacugggcgcauuucuagcugaucaaccuacccagagaaggcgguacacugaccgagccauguauguagaggaguucgaacagcucuggagcaaacaggcguccuuuacacaagaacagcugacccaggcccuuaagguggcaauucacaacucuaucuucuuucaacgcccacugaaaucgcagaagcauuuggucggcaaguguacguucgagcccacuagaaaaagggcugccaaggcuauacuccugacccagcgguuucgcaucuuacaggaugugaaucaccuggccguuaaaaacccuauuacaagagaguucaggccacucacucaagacgaacguaauaaguuggcagaggcccuggauaaacagaagucaaugaccuggggagcugugcggaaagucaucggguggaacaagaaggacagcuugcacgaaggugagacauuuaaucuagaagagggcaaaaaggacaaacugauugggaaccgaaccgcgugcgaucucagaggagcacugggcgacaggugggaugcccuuacggcucagcagcaagacgaucuggugacugacuugcucacaaucgauaacaccgacgguuuccugaagcgcaugaaaacucauugggaguucgaugacgccacagcagaaguaauagccaagauugaguuagaacccggguacgcucggcugagugccaaggcaaugagagcgauccuaccuuaucucgagcagggaaugauuuacuccgaugcuuguaaagccgcaggcuaugaccacucuaauccaaaccagaggaccaucacggacaagcugggccuuccgagcaauguucgcaaccccgugguccagaaagccuuguuugaaacccgaaagguggugaaugcuaucguccggaaauacgggaagccugccguuauucguguggagauggcaagagauaugaagcuguccaaaaggcaaaaggaggaacuccagaaagagcagaacaagcagaaaaaggcuaaugaacuggccgagggaauacuucgcaaggaguucgguauccaacagccagcgcgggccgacauucagaaauacaaccugugguuggaaugcaaggagguaugucccuauacaggcacuaccaucucaagagaaaugcucuuuaguccugagguggaugucgaacauauacugccauacagcaggucuuuagacgauuccuauaugaauaaaacacugugcauggcuacuuucaaccgacaagugaagcuaaauaacacccccuacgagauugggcagggagacccgcucgcauaugccgagaucuuucagcgcaucaaaacacugccuuuccccaagcggagaagguuugaacagaaagagauugaaaccgauaaguucaucgagcgucaacuuaaugacacucgcuacauuuguguugaagugcgggauuuucuucagcagcugggcgcuccagucgaggugucaaagggugaggccacggcaaaacucagagggagguggaagcugaacacauuacugagcccugacggcaguaaugaaaaauaucgaggagaucaccggcaccaugcgauagacgccguaguuaucgcucuuaccaaccgcucuuuguuccacaagcucuccagacugagcgcccagucgauuucucuagauaaauccagguuugacgugcccccacccugggacggcuucuacgaugacgucuacgagaagaucgauaaggugaucgucucacaugcuccugcacggaaaauugggggagcccugcacgaagacacugcauauggucauuuuaaggaggaaguggccgauccaaaaaccggcaagguuaguauagaggaccgauucguguacagaaaaccgcucgcuacacugaccgcgaacgagguagggaagauccgcgaugccaaggucagggaguucguggaagcacgucuugcucaauuuggaaauaacagcaaaacugccuucggcgaccccaauaacccuuugcugcacgccgaugguaagacaccaauucggacgguuagauuagugaccaauuuuaacaaagcuacuacacacgcaauccagaaggggcagggcagggacuauaaauucuuuaaguacggaaauaaccaucacgucgaaauuaucgagcauguggaaaccggcaagcgcaaagggauauucguaacagccauggaggcggcucgaagagugcggggaguugccaauacugagaaguccgauaucguccagaggaaccacggugaagaguggcgcuuugugaugucucucagcauuaaugaccuggugucaauccaagaagcagaucagguccguauuaugagaguucagcuuuucgacgccaguaacggcaauaucauauuucgggaccaaaaauccgcuaugcuggaugacaaguugagcagguaucagaccaaagcacaccuccuggugugccagaagauuacgaccgauccccuagggaaccuggccccuuguaaugacuga

SEQ ID NO: 2576 - RNA, 2988 nt, Artificial Sequence
  Cas9 variant
augagcaaggugcugggccucgacaucggggccaacuccauuggaugggcucuuauagaugacgaggaaaaugauaucauuggugcaggcgucagaguuuucaaagagggggugaaccugaagggaguaaaagaagagucuaagaauguggaaaggcgggccgcgcgcuuggcucgacgucagcacaaaagaaggucacaacggcgcaacagauuagucgcccugcuaaagacccucgagauguuucccgagaauaacgaagacaucagugauuacuaugcacaggacccuuacgagcugaggaagaaaggccuuuaugaaaagcugacaauguacgaguucggucggguguugcuccauauuugccgccgaagaggguuuaaaagcuccaggaagacugauaucucugaggaaggaaaaauauucgagggcaaggacggcaucguugggauuaaucagacgcgggauucgauccgugaaggagguuuuaagaccauuggcgaguaucuggccucacuggacccacacgugauccgcagaaggaaccgguucacacuccgagauauguacgaagaggaguuuaauuuaaugugggaaaaacagcagagcuucuauccgcugcaacuuaguaacgaguuuaaggaagcuauagcagaggucauuuugucccagcgcaaacugaagucucagaaagcccuaguggggaauuguggacucgaacccaacaagaaaacugcuccuaagagcuccccagccuuccaauacuuuagaauccuggagcagcuuucaaggauucugaucaguaucccccauaccggccgguacaaugacccuuugaacgaggaggagcgcagaaugcucauugauaagcugagcguaacagaaaaauuaaaguucucugacaugaggaaaaugcugaaucucccaggugaguccgacauaaacaucgaagaggaagggggacgucuucugggcaacaccacuuaugcgcgguugauuaagguuuuuggcaaaaagcgaugggcaggguucucagaagaggaaaaggagcagaucuggcacacauuccauuuugccgauaaucacgaguggcuaaaagaauacgcucugaagaaauggagcauaacccccgacgagauuaaggaacucggaaaaguggcccuggagaaggaauaugcaagauucaguaagaaaucucuuaagaaaaucaucccucagcuggaggaggguuugacgcucgauaaggcuaaaauugaagccggcuacacuccagaguaugaaaucgagaagucccugagcgcguacuuaccgcugcccgaaaacauuaggaauccuauaguccaacaggcccuauaugagcuccgccacguggugaacgcagucauccggaccuacgggaagccagacauugcuagaguugagcuggccagggaaaugaaaaagcccaaacagaagcgcgagaaaaugcgaucggaacuucggaagcgucaaaugaaauuugaggaaaucaagucuaucuugaaggagagacugggauucauugauccuaaaagggacgagauacauaaguacaugcucugggaagagugccgcgaaacauguccauauacuggccggaaaaucucccugucagcucuuuacgguggggauuuugagguggagcacauuauccccuauaagagaagucuggacgauagcuuguucaauaaaaccguaugccucagggaagagaaccagauuaagggcgaccgaacaccguacgaagccuauuccggagaucgccagaaguacgaggaaaucauacugcgggugcagaaaaccucuaugccuagaggcaagaaaaauuuauuugcaaucaaggagcugaaagacgacuucgcccauaggcaacuaagcgauacggcuuauauuucacgugagacucgcaaguaccucgggaguacaaucaagaaaguccaggcggugaagggagguuccaccgcaaaacugcgguacuauuggggccuuaacagcauuuuggggguuagagacaucaagaugagggaugaccaccgacaccaugccguggaugcucuggucauagccaauacuacauacgcauuugugaacacccucucucgguaucacucaauggacguagaaccccaugagagucgcuucccacugccuugggaacaguuuagaaaugaugccgagagcguugugaggaacauuuucgucucccaccgguuaggcaaaaaggcuacgggacagcugcaugaagagaccuacuaugguaagauccgaaauacagacggggagcccuacuuuguggucagaaagaaacuuggcacuuugaccgccaaacaaauugcaaacaucguggauccaguugugaagacacagguauucgaacgccucgaggaaaaaggaauagacaucgagucuucgaauaagauucccgcggaugcuuucgucgaaacucuguauaugccugacaggaaaaccccaaucaagagcgugcguguuaaggugccguccacaaccaugauucagcuauacaaagauaaggagcuguacgucgaccccggcucaaaccaccacaucgugauauuugagaacgaagaggggaaacgggacggaauuguagugagucucuucgaagccgcacagagacugaggcgcaaugagccuguuauccaaaagacuuggaaaccagaguggcauuuugucaugucucuuagcaucgaugaauugauucuguuagacguggaugagaagaacaucgacuggggugauacgggccucgcccugcgauauuccaaggcucuuuacagagugcagaaaauggacgucaauaagauuauaacacugcggcaccauuugguugccaggcucaaagaugacgaagggaaggaguucggacgcgaacaccguauccccucaacccugagaggccuaaaagugaagauugaucacaucggucggcugaggcgcgcauaugacuga

SEQ ID NO: 2577 - RNA, 2988 nt, Artificial Sequence
  Cas9 variant
augaaggugaucggcuucgacauugggauaaacagcaucggaugggccuuugucgagaaugaugaacugaaagacugcgguguuagaauuuucaccaaggcugagaaccccaaaaauaaggaaucccucgcacuuccuaggcggaacgccaggucuucacgaaaacgucugaagagaaggaaguugcgguuaaucgcgaugaaacacauucuggcuaaggagcuaaaucucaacuacaaagauuauaucgccaaugacggcgaacugccaaaggcauacgaggggaaacuuauaaguccguaugagcugcgcuacaaggccuugaaccagaagcucgaagcuaaagaucuggugagaguaauccugcauauugcaaagcacaggggauauaugaauaaaaacgacaagaaaagcaaugaugccgagaagggcaaaauccucuccgcuuuaaagaacaaugcccugaaacuugaaaaauaccaaucugugggugaguauuuuuacaaggaguucuuucagaaauacaaggaaaacacaaaagacuucauuaagauccggaauauaaaggauaacuauaacaauugugucuuggcgucggaccuggagaaagaacuaaagcucauucuggagaaacagaaggaauuuggguacucauauagcaacgauuucaucgaggaggugauucagguugcauuuuuccaacgcccccuuaaagacuuuagucaucuggugggaacuugcacguucuuugaagaggaaaagcgagccuguaaaaauuccuacucugcuugggaguucgucgccuugaccaaaaucgugaacgaacucaagagccuggagaaaaucuccggcgaguuaauuucaacacagacuauaaaugaaauccugaacuauauucucgauaagggcaguaucaccuacaaaaaguucagaagcuauauaaaucuuuacgagucuauuaaguuuaaaucccugaaguacgacaaagacaacgcagaaucagcuaaguugaucgauuucaggaagcuaguagaguuuaagaaagcccugggggaacacuauuucaaucggcaggagcucgaccagaucagcacauacauuacccugaucaaggauaacguuaaacuuaaaacugcgcuggagaaguauaauuugaguaacgaacaaauuaauaaccuccuggagauagaauuuaaugaccauaucaacuuaucuuucaaagcccuguccaugauucuaccucucaugaaggagggaaagaaguacgaugaggcaugcgaaaucgcuaaccugaagccaaaaacaaccaaucagaagcaggacuuucuucccgccuucuguaacagcaucuuugugcacgaguugucgaauccuauugucaaccgugcuauaucugaauaucgcaaagugcugaaugcccuccugaagaaauacgguaaggugcacaagauccaucuugagcuggcaagagauauuggcuuguccaaaaaggccagggaaaagaucgagaaggagcagaaagaaaaccaagcuauuaauacgugggcgcucaacgagugcgaaaauauggggaucaaggcaaacgccaagaauauacugaaauuaaagcuguggaaagagcagaaggaaaucuguauuuauucaggcaaaaagaucaguauugagcaccuaaaagacgagaaggcucucgaagucgaucauaucuacccauacagccgguccuucgacgauucuuauaugaacaagguucugguguuuacuaaagagaaucaggaaaaacuuaacaaaacccccuucgaggccuuuggaaagaauauagaaaaauggaacaagauucaaacauuggcacagauccugccuuacaagaaaaagaacaaaauucucgacgagaauuucaaggacaaccagcagcaagauuucaucagccgaaaucugaacgacacucgcuauauagccaccuuaaucgcuaaauacacaaaggaguaucugaauuuucuuccauugaacgaaaaugagaacauuaaucucaagucaggugaaaaagggaguaagauccacauucagaccguaaacggaaugcugacguccgugcuaagacacacuuggggcuucgauaaaaaggacaggaauaaccaucugcaccaugcccucgaugcaaucauagucgcguacagcacaaauucucugauuaaggcuuuuucagacuucaagaagaaccaggagcuuuugaaagccaagcuguaugcaaaagaguuaaccaaugauaacuacauccaccaggccaaguuuuucgaaccguuugagggcuuccgggagaaaauccucaacaagauugacgaaaucuuugugaguaagcccccucgcaaaagagcucgcggggcccugcauaaggaaacuuucuacagcgagaaaaagaugauuaaaaaguauaauuccaaagagggacuuaacauagcacuggauugcgguaagauccguaagauuggcacaaaauacguugaaaaugacaccauggugcgggucgauaucuuuaagaaacaaaacaaguucuaugcuauuccaaucuacacgauggacuuugccuuggggauacuccccaauaaaaucgugguaauuggaaaggauaagaacaauaacccuaaacaguggcaggagaucgacgaaucuuaugaguucuguuucucgcuguacaagaaugaccuaauucugcuccagaaaaaggauaugcaagaagcggaguuugccuauuacaacggcuucgacaucgauagcucccgaauaaauauuaaaaagcacgacaacaaguuugagaaucugaccucaaaccagaaacuuuuguucacaaauaaggagaaaaacagaacugguauccagaaucugaagaucuuugaaaaauacauuguuaccccauuagggaacaagauaaaggcugauuuccagcccaggcaaaacaucagucucaaaucuagcaagaaaaauggccuguga

SEQ ID NO: 2578 - RNA, 2988 nt, Artificial Sequence
  Cas9 variant
augaagauccugggcuucgacauugggauaaacagcaucggaugggccuuuguggagaaugaugaacucaaagacugcggugucagaauuuucaccaaggcugagaaccccaaaaauaaggaaucccuugcacugccuaggcggaacgcccgcucuaaucgacguagauugaaaaggcggaagucacgcuuaaucgcgauuaagcacauccuggcuaaagagcuaaaccucaauuacaaggauuauauagccaacgacggcgaacugccaaaagcauacgaggggaaguuaacaaauguuuaugagcugagauacaaagccuugaaccagaagcucgaagcuaaggaucuggcaagggugauccugcauauugccaaacaccggggauauaugaauaagaacgagaaaaagaguaaugacagcgaaaaaggcaagauccucuccgcuuuaaagaacaaugcccugaaacuugagaaguaccaaucuguaggugaguauuuuuacaaagaguucuuucagaaguacaaagaaaacacuaagaacuucauuaaaauccgcaauacgaaggauaacuauaauaacuguguguuggcgucggaccuggaaaaggagcuaaaacucauacuggaaaagcagaaagaguuuggguacucauauaaugaugacuucauuaaggagaucauuaacaucgcauuuuuccagcgaccgcuuaaagauuuuagccaucuggucggaaguugcaccuucuuugaagaggaaaagagagccuguaaaaauuccuacucugcuugggaguucguggccuugagcaagaucauuaacgaacucaagaggcuggagaaaauauccggcgaguuaaucucagcacaaacaauuaaugaaauccugaaccacauacucgacaagggcaauauuacuuauaaaaaguuccggaguugcaucaaccuucaugagagcaucgaauuuaagucucugaauuacgauaaagacaacgcugaguccgccaaguugguugacuucaaaaagcuaauugaauuuaaaaaggcgcugggggagcacucauucaaucgucaggagcucgaugaaaucgccacccacauuacacugauaaaagacaacgauaaacuuaagaccgcacuggagaaguauaacuugaauaacgaacagaucaaugcucuccuggagauugaguuuaacgaccauaucaaucuuagcuucaaggcccugaaccuaauccucccccugaugcgcgaaggaaaaagauacgaugaggcuugugaaauugugaaucuuaagaguaaaacuucuaaccagaagcaagacuugcugccugccuuuugcgauuccauauucagccaggagcucucgaauccagucgugaacagggcaaucucugaauaccggaagguacugaaugcccuucugaaaaaguaugguaaaguucacaagauucauuuggagcucgcucgagacgugggccuguccaaaaaggcgcgcgagaagaucgaaaaagagcagaaggaaaacaaagagauuaaugauugggcauuagacgaaugugagaaguuugggcugaaagccaacaauaagaacauccuaaagcucaaacuguggaaggagcagaaagaaauaugcgcuuacucaggaaagaaaaucaguauugagcaccuuaaggaugaaaaagccuuggaggucgaccacaucuaucccuacagcagauccuucgacgauucuuauaugaacaaggugcugguguuuacaaaggaaaaucaagagaaacucaacaagaccccuuucgaggcauuuggcaaaaauauugaaagguggaacaagauccaggcccuggcucagaauuuaccauacaaaaagaagaacaaaauacuggacgagaauuucaaggauaaacaacagcaggacuucauuagccggaaccuuaaugauacgcgcuauaucgccacuuugauugcaaaguacaccaaagaauaccucaacuuucugccccuaaaugagaacgagaauacaaaccugaagucaggugaaaaggggaguaaaauccauguccagacuauaaauggaaugcucaccuccguucugagacacacauggggcuucgacaagaaagauaggaacaaccaucuucaccaugcguuggacgcuaucauuguggccuauagcaccaauucuaucauuaaggcauuuucagauuucaaaaagaaccaagagcuguuaaaggccaaacucuacgcuaaggaacugacgagugacaauuauaaacaccaggccaaguuuuucgagccuuuugaaggcuuccgugagaaaauccuuaacaagauagaugagauuuuuguaagcaagccaccgcggaaacgagcaagagggacucugcacaaggaaacauucuaccccgaggaaaccaugaucaaaaaguauaauuccaaagagggauugaacaucgcucucaauugugguaagauuaggaaaaucggcacuaaguacguggaaaacgacacaaugguccgccuggauauuuuuaagaaacagaauaaguucuaugccauaccuaucuacaccauggacuuugcgcuagggauucugccaaacaaaaucgugauugccggaaaggacaaaaauaacaaucccaagcaguggcaagagaucgaugagucuuacgaguucugcuucucgcucuauaagaacgaccugauacuuuugcagaaaaaggauaugcaggaagcugaauuugcauacuauaauagcuucgacaucgauuccucacggauuaacaucaaaaagcaugacaauaaauuugagaaccugacggauaaccagaaguuacucuucaccaaucaagaaaagaacagaacaggcauucagaaucugaaaaucuuugagaaguacauaguuacuccucuuggugacaaaauuaaggccgauuuccagccaaggcagaacaucagucugaaaaccucuaagaaguaugggcuauga

SEQ ID NO: 2579 - RNA, 2991 nt, Artificial Sequence
  Cas9 variant
augaugggcaacuucacccuggggcucgaccuuggaacaaauagcaucgguugggcccugauugauuuugacgauaaccagcaaccccagaauuugauagcuugcggcuccagaaucuuccaggaggcaguggaagccaagacugggacgccuaaaaaccacgcgaggcgggcugcccgcgcagcccgaaaguuagucgcucguagaaaacagaggcggaccaagcugcuaaaucuccugguuugucaugaccuucugccacaagaugaggcagaacgcaacgccuugcuccuggacaaucaggcuaacaauccguaccagcugagaaaaaggggacucgaugagaaguuagaacccuuugccuucggccgggcgcuguaucaccuugcacaucgccgagguuuucagucuaacagaaaggccgcuucagacgaggaugggaaagugaagacagccauuagugcauugagggcugagaugcaaggacacacucugggcgccuuccuagcggaccagccuacccagcggcgucgcuacacagauagagccauguaugcagaagaguuugaacagcucuggagcaaacaaaccaucuucgcuccagagcagcugacucaggcccuuaagguagagauuaaaaauuccaucuuuuuccaaaggccccugaagucucagaagcauuuggugggcaaaugcacauuugaaccuacccggaagcgagcugccaaagcaauacuccuggcccagcacuuccgcaucuuacaggacgucaaccaccuggcugugaagaauccaauuacgagagaguuuaggccccucacucaagaugaacggaacaaacuugcggaggcacuggacaagcagaaagggaugaauuggucggccguucgcaaggugaucggauggaacaagaaagacucauugcaugaaggugagaccuucaaccuagaggaaggcaagaaagauaagcugauugggaauagaacagcuugugaccucaggggagcccugggcgaucguugggacgcauucacugccccucagcaggaugaccuugucaccgaucuguugacaaucgacaacccagaugguuuucucaaacggaugaagacccacuggggguucgacgaugcuacggccgaggcacuggcgacuacagaauuagagccgggauacgcucgacugagcaguaaggccaugagagcaauacuaccccaucucgaacaaggcaugauuuauuccgacgccugcaaagcugccggcuacgaccacucuaauccuaaccagaggaccaucacugauaagcuggggcuuccaagcaaugugcgcaaccccguaguucagaaagcauuguuugagacacggaagguggucaaugcuauugugagaaaauauggaaagccugccgugaucagggucgagauggcgcgcgacaugaagcuguccaaacgacagaaggaggaacuccaaaaagaacagaacaagcagaaaaaggccaaugagcuggcugaagguauccuucggaaggaguucggcauucagcaaccagcacguaccgauauacagaaauacaaccugugguuggaguguaaggaaguuugccccuacacggggaccgugaucucaagagagaugcucuauaguccggaaguagacguggagcacauucugccuuacagcaggucuuuagaugacuccuauaugaauaaaacacuguguauggccacuuacaaccgccagaccaagcuaaauaacacacccuaugagaucggacaaggcgauccagucgcuuacgccgaaauauuucagcggauuaaaacucucccuuuccccaagagaaggcgauuugagcagaaagaaaucgagaccgacaaguucaucgaacgccagcugaaugauacacgguauauuugcguggagguuagagacuuucuucaacaguugggugcaccaguggaggucucaaagggggaagcgaccgccaaacugaggggccguuggaagcucaacacucuguuaagccccggaggcgggaacgagaaaaaucgcgcugaucaucggcaccaugccaucgacgcagugguaauugcucugacgaacagaagucuuuuccacaaguugucuaggcucuccgcccagagcauaucguuugauaaaucucgauucgacguuccuccaccgugggacgauuuuuacgacgauguguacgaaaagaucgacaaggucauugugucccaugcacccacacggaaaaucucaggagcccugcacgaggcuaccgcguauggucacuucaaggaagagaucgccgauccuaaaacuggcaaguucaguauugaggaccgcuuugucuacagaaaaccacuaaccacacugaccgcaaaugaaguggggaagauaagggaugcuaagguucgggagcucguggaagcccgacuggcccaguucggaaacaauagcaaagcugcauuuggcgaccccaacgagccucuuuugcaugccgaugguaagacuccaaucagaacaauucgccugacgaccaauuucaacaaaacuacaacccacgcgauccaaaaggggcaggacagggauuauaaauuuuucaaguacggcaauaaccaucacguagaaauuaucgagcacgucgagacaggaaagcguaaaggcauauuugugacugcuauggaagccgcacggagagcccgcgggguugcuaauaccgagaaguccaacaucgugcagaggaaucauggagacgguuggaaauucgucaugucuuuagcagugaacgauaugguacgaacggaagacacccaggccauuuauagagugcaaaagcucgacggcagcaauaaccgguuuacacugaggucacacaacgcggcuacucuugaugacaaacagaccgggguugauaagacacccaaucuguucaaaggaacuaagaucauugucgacccguugggcaaccucacccaguguaaugauuga

SEQ ID NO: 2580 - RNA, 2994 nt, Artificial Sequence
  Cas9 variant
augaaggugcuggucgacgccggccucaugcccagcgauccugcugcagccaaagcgcuugagacccuggacccauacgaauugagagcuacaggguuagauguuaugcugccgcuaacucaccucggaagggccguguuccaucugaaccagcggcgcgguuuuaaguccaaucgaaaaacggaccguggcgauaacgagucugggaagaucaaagacgcaaccaagagacuuacaugggccaugcaagaagcuggagcaaggacuuauggcgaguuccugcacaugcggcgcgccagagcuucagaucccaggcagguaccuagugugcggacccgcuugagcgucgccucccgaggugggccagacucuaaggaagaggcgggauacgauuuuuaucccgagagagcacaucucgaagacgaguuccacgcccuguggucggcucaggccgcauuucauccugaucugacaugcgaacucagggacgugguuuucgagaaaauauuuuaccagcggccauuaaaggagcccaaagugggccugugucuuuucaccgcugaggaacguuugccuaaggcccacccacugacuggccgcagaguccuauaugaaacagugaaucaacucaggguaaccgcggaugggcggacgacucgaccgcugacccuugaggaacgcgacaugauuguuuacgcccuggacaacaaaaagcccgugaagucauugagcaguaugcaccucaaacuggucgcauuaggaaagcuggugaaacucaaggauggugagagauuuacacuugaguccggcgugagggacgcuaucgccugcgauccuauucgggcuacuauggggcauccagacggauucggccccgccuggucucgccuggauuggcaggcacagugggccuugaucgaaaaacuaagacagguccaaagcgacgaugacuuugcuucccugguugcguggcucggugcaacccacaaucugucagaggaucaugccaagaggguggcuaaccuucaucugccugaaggguauggacguuugggccucacagccaccgaggcaauucuguguaauuuaaaagccgaaguaugcacguacagucaggcuguggagcgguggggcaagcaccacagcaaccagcgaacuggggagugucuggaagcccuaccauacuauggagagguccucgacagacacgugauccccgguacauacaaugaagaugacgacgauguuaccagguauggccgcauaacuaacccgacagugcauaucgggcugaaucagcuucggagauuggucaacaggauuaucgcaaccuacggaaagccugaccaaauugugguagagcuggcgcgcgaacucaaacagucugaggcucagaaguccgaggcccugaaaaagauccgagauacgaccgcagacgccauacggcguggcagacaacuugaagagauuggucagaaaaauacaggggcuaacaggcuguugcuccgccugugggaagauuuaggccccgccguuggaccacggugcuguccuuauacuggcaagcccaucucagugaccaugcuguucgacggggcaugcgaugucgaccacauucuaccauacagcagaacacucgaugacaguuuugcuaauaggacuaucugucugcgagaggccaaccgccagaagggagaucggacccccugggaggcgugggguggcucugaccagugggaugccaucgaagcuaaccuuaaagacuugccugagaauaagagaaaaagguucgcaccagacgccauggaacguuucgagggggaacgcgauuuucuggaccgggcucucguggauacacaauaucuggccagaauuuccagggcauacuuagacacccuguucacugagggaggccaugucugggugguuccgggucgaaugacggagaugcuucggcgccacuggggguugaacgcgcuccugagcgauaaggacagaggcgccggaaaagugaagaauaggacagaucaccggcaucacgcuauagacgccgcaguaaucgcugccaccgaucauucgcuagucaaccgaauuucuaaggcagccggccagggggaauccgcuggacagucagcggagcugaucgccagagacacucccgaaccuugggaggguuuucgcaaugauauaagugcacagauugcuaggaucgugguuagccaccgugccgaccacggccggaucgauguggaagggagaaaacauggaaaggacuccaccgccggcaggcuccacaacgacacagcuuacgguauugucgaugaccauaccgugguaucucgcacuccacugcuuagcuugaaacccggggauaucgaggugacaacgaagggcaaaaauauucgagacacccaacugcagaaggcauuaucaguugccacuacaggaaaggauggcaaaggguucgaggaagcgcucagaaacuuugcugagaaggaaggaccuuaucagggcauacggaggguccgccugaucgagacccuucagaguuccgcccguguggaaguggguagcgacgaggaugggcaaccacugaaagcauacaagggagacucuaaucacugcuaugauuuguggaaacuccccgacggcaaggucguuccgcauguggugucaacauacgaggcccacgcugguacugauaaaagaccucacccagcagccaagcggauucugaggguauucaagaaagacauggucgcgaucgaacaggacgaucagaccgcuaucuuuuaugugcagaagcuagaccgcgccaacggccuguuccucgcaccccaucuggaggccaaugcugaugcccgacacagaaacccuaaugacgcauuuaaauuccuucaaaugggggcuggaaguguugugcggaacaaguugaggcgcgucuacguggaugaaauuggcagaauaaaagaccccgggccaccuaagcauuga

SEQ ID NO: 2581 - RNA, 2994 nt, Artificial Sequence
  Cas9 variant
augaagauacugggcuucgacauugggauaaacagcaucggaugggccuuuguggagaaugaugaacucaaagacugcggugucagaauuuucaccgaggcugaaaaccccuccaauaaggagucucuugcacugccuaggcggaacgcccgcucaagucgacguagauugaaaaggcggaaggcgcgcuuaguugcuaucaaaaggauucuggccaaggaacuaaagcucaauuuuaaagauuacguggcagccgacggcgagcugccaaaggcuuaugaggggaaacuuacaagcaucuacgaacugagauauaaggcauugauacagcaacucgagacuaaagaucuggcccggguaauccugcacauugcuaagcaucgcggauacaugaacaagaaugagaaaaaguccaacgacacgaaaaagggcaaaauccucucugccuuaaagaauaacgcgcugaaacuugaaaauuaucagucggugggugaguacuucuauaaggaauuuuuccagaaguacaaagagaacaccaagaauuuuauuaaaauccgaaacacaaaggauaauuacaacaacugugucuugucaagcgaccuggaaaaagagcuaaagcucauacuggaaaagcagaaagaguucggguauaauuacagugaggauuuuauuaacgaaauccuuaagguggcauucuuucaaagaccgcugaaagacuucucccacuugguuggagccugcaccuuuuucgaggaagagaagagggcuuguaaaaauucuuauagcgccugggaguucguggcacucaccaagauuaucaacgaaaucaagucccuggagaaaauuucaggcgaaauaguccccacacagaccaucaaugagauuuuaaaccugauccucgauaagggcaguauaacuuacaaaaaguuucggagcugcauuaaucuucaugaaucuaucuccuucaaaucacugaaguaugacaaggagaacgcugaaaaugccaaauugaucgauuuucguaagcuaguggaguucaaaaaggcgcuggggguacacagccucagucgccaggagcuggaccagauuucuacacauaucacccuuauuaaagacaacguuaagcugaaaacgguguuggaaaaguacaaucucuccaacgagcaaauaaauaaccuguuagaaaucgaguuuaaugauuauauuaaccugagcuucaaggcccuaggaaugauccucccucugaugagagaggguaaaagguacuacgaagcaugugagaucacuaaccuuaagccaaaaaccgucgacgaaaaggaggacuuuuugcccgcuuucugcgauucgauuuuugcccacgaacugucuaauccuguggugaaccgggcuauauccgaguaucgaaaaguccucaaugcccugcuuaagaaguacggcaaaguucacaagauccaucuggaguuggcacgcgauguggggcucaguaaaaaggccagagagaaaauugaagaccagcagaagaacaauaaggcuaucaacgauugggcgcugaaagaaugugagaauauuggaaucaaggcaucagccaaaaacauauuaaagcugaaacuauggaaggaacagaaggagaucugcauuuauagcggcaauaaaaucuccauugagcaccucaaggacgaaaaagcucuggagguagaucauaucuacccauauucuaggagcuucgacgauucauuuauaaacaaggugcuugucuucacaaaagaaaaucaagagaaguugaacaaaacucccuuugaagccuucgguaagaauauugagaaguggaguaaaauccagacccuggcacagaaccucccuuacaagaaaaagaauaaaauucuggacgagaacuucaaggacaagcaacagcaggauuuuaucucccggaacuuaaaugacacacgcuauauaaccacgcugaucgccaaauacacuaaggaauaccuuaacuucuugccacucagcgagaaugaaaacacaaaucugaaaucuggggagaagggaucaaaaauucacauccagaccauuaguggcaugcuaacuagcgugcugagacacacauggggcuuugauaagaaggacaggaacaaucaucuccaccaugcucuggaugccaucauaguugcauauuccaccucuucgauuaucaaagcguucagcgacuuuaagaaaaaccaagagcuuuugaaggcucguuucuacgccaaagaacugacguccgauaauuauaagcaccaggugaaguuuuucgagccguuuaaaggguuccgggaaaagaucuuaucaaaaauugacgagaucuuugucaguacucccccucgaaagagagcaaggggagcccuccaugaagagacauucuacucugaggauaaaaugauuaagaaguauaacagcaaagaaggucugcagauagcucuuuccuguggccgcgugcggaagaucgggacuaaauacguagagaaugacaccaugguuagaguggauauuuuuaagaaacagaacaaguucuaugccaucccaauuuacgucauggacuucgcacugggaaucuugcccaauaaaauagugaucacaggcaaggauaagaacaauaacccuaaacaauggcagacuauugacgaaucauacgaguuuugcuucagccucuauaagaacgaccugauccuacugcagaaaaagaauaugcaggaaccagaguuugcuuacuauaacucuuucgauauugacaggucccgcaucaaaauaaagaagcacgauaauaaauuugagaaccucaccaguaaucaaaagcugcuuuucacaaacaaagacaaggguaaaaaucgaaccgggauucagaacuugaagaucuuugaaaaguacaucgucacuccccugggcgauaaaauuaaggccgacuuccagccgcgggagaauaucagcuuaaaaacgucuaagaaacacggacucuga

SEQ ID NO: 2582 - RNA, 2994 nt, Artificial Sequence
  Cas9 variant
augggcaacuacacccuggggcucgacaucggaagcaauuccauugguugggcccuuguggaggaugcugucgaagcacccagaauaguugacaugggcgugaggguauucccugaggggguggaucgggacacaaagggacuggaaaaaucuaagaacgccacucgccgagaggcgcguggcgcuagaaggacgcaccagcggcgcagacaaaggaaacagcgguugguccgcgccuuacgacaggugggucugcuaccaugcgauaaggcagaaguuagaucacucuuucagaccgacccguaugagaucaggaaacgggggcuggaucaucgucuugagcuguacgaaauuggacgcgccuucuaucacuugagucaaagaaggggcuuuaagagcaaucggaaguccggcgcucucaaagaggacgggacagugaagaaagaagcaggagagcugcagcgaaagaucgaugaggccgguugucgcacuauuggcgaauacuucgcugggcuggaccccgagcagcagagaaucaggggacgguauaccuuucgcucuauguaccaaaaagaauuugaucucuuaugggccaagcaggucgaguuuuauccuaaggugcugacagaagaccuuagaucgaaaguaagggaugagauaaucuucuuucagcguccauugaagucagcgaaagaccugauuggcgacugcgagcuagaacccaccgagaagcgguguccucgagcagauugguacgccagaagguuccgccuccugcaggacaucaacaaucuuauuauccaaaacccagaugguacugaacagaaacugagccccgaccagcgggcugccuugcucggggagcugggacaaagagaaaaguuaacauuugauaauauaagggcaaaacugggccuccuugagacccagaaguucaacgcugaguaccgcauuggccgaaaggggaaaaagguugaagccaucaaaggagacguguuugucuggacgaugcgggguaagaguguguucggcccuaaagcgugggaugccauggcagacgagcguaaggugucccugaaugaauuguucgucgagcuagaagaugacgaucuggcuagaaagcucgagacugaguaugggcugaccgacaaacagguucaggccgcuaugaaggccucucuuccacaaggauacaugagcuuuuccaggaaagcagugcugaaguugcucccguucauggaagccggcgcucugacacaugaggcgauugaccaggcagguuaucgcaaagaggaacccacucagaccgaugccaucgcucggguaucauuuccuccagacuuaagaaaccccaucgugcagaaggcccuguucgaggucaggaaggugguuaaugcccuagugcgagaauacgggaaaccuacacgcauuaagauagagauggcacgggauguccaaggcaguaaaagacagagggaggaacuccacuggcguaacgaagacaaucgcaagaaaaacgaggaggugcgggauagacugaggaccgacauccauauugaugacccaagccgagaugacguaaucaaguauaaacuuuggcaggaaucuggaaaaaugugccccuacacgggccggcagauaugucaagaggcuuuguuugggccgaauccugaguuccagguugaacacauucugcccuaugaucgcucccucgacgauucauacaugaaccugacucuuugcgaagugcacgagaacauccauggaaagagaaaucagacaccauuugaggccuacgguagcggcgcagaaagguaugagcagaucaaacaacggauuaagguccugccuuggcccaaacgacagaaguucuugcagcaagaaaucaaccucgacagucacauuucuagagagcugaaugacacccgcuacauauguagggaaacuguggcguauuuaaaacagcuggggguccaugugcguggaacacggggcaagaucaccgcugagcuaagacaccaguggggucucgaugggauuuucuccgagcugggcguuaggcgcgacgaugaccaccgaagacaugccguggaugcacuuguagucgccgugacggacaacgaacacuugcggaggcuggcuguuagcaaguacgugcucgccggaccacgcuucgagacccccuggucggcauuucgugaugaagcuagaggcaaugucaaacggaugaacgugucucauaggguaugccgcaagguguccggggcccugcacgaggagacaaauuauggaccuacugguguucgagaccaggcgggccaagauaucuacgccuauagaaagaaguuagaagaccugaccacaccaauggucgagaaaaucguggauccggugguccgggacauuguuaggcagcgccuuuugaugaaggggauagaucccgcugcagccgacagaaagaucccuaaagacguguggaaggaaccacucuacaugaggcggacuaaaucagauaagaugauucagauccgucgcgugcgaauccaugacgucaaaaacaguauuauaguacugaccgaugagagcggaagacccuacagggcuguggaaccuggcgguaaucaccacguugagguguucgaguauguccaugggacaaagaccggcacucgggaagccgaggugguuacgauguuugaagcagugcgcagauccagggcgcgggccccaguaguccgaagagaccacggacccggcacacgcuucguguguucucuagcuaucaacgauauggugaugaugccggacaagagcgggaaaauggaucuguucaggauucagaagaugucagccaguaaacaagucuacuuucggcaucacaccgcagcucguaucgacuccgagagaacucucauuaggaagcaggcccaccuguucaauggauauaaaguuagcguggauccuaccggcgcaaucugccgcgccaacgacuga

SEQ ID NO: 2583 - RNA, 3000 nt, Artificial Sequence
  Cas9 variant
augaagauccugggcuucgacauugggauaaacagcaucggaugggccuuuguggaggauaaucagcuccaagacugcggugucagacuuuucaccaaagcugaagaucccaagacaaaagagucccuggcauugccuaggcggaacgcccgcucuaaucgacguagauuaggcaggcggcgcucaagacugauugcgcuaaagcacaucauuaguaaagggcucaagcugaacuaccaggacuauaucgcuaaugauggagaacuuccaaaggccuacgagggcaggcugauaagcccguaugaauugcgguacaaagcacucaacgagaagaucgagcccaaagaccuggcccgcguuauucugcauaucgcuaagcaccgagguuauaugaauaaaaacgaaaagaaguccucugauaaugagaaagggaagauucucucggcauuaaaaacuaacgcccugaaacuugaaaaguaccagucagugggagaguauuuuuacaaggaguucuuucagaaauacagagaaaauacgaaggacuucaucaacauaaggaauaaggagggcagcuaugaaaacuguguauuggcuagugaucuggagaaagaacuaaagcucauucuggagaaacaaaaggaguggggcuacuccuauaaugacaacuuuaucaaagaaauucuuaagguggccuucuuucagcggccucugaaggauuucucuuacuuggucggggcgugcaccuuuuucgaggacgaaaaacgugcauguaagaacagcuauuccgccugggaguuuguggcucucacaaaaaucaucaaugaacugaagucauuagagaaagagaguggagaacugguuagcucucagauuauaaacgagauccucaaucauauucuugauaaggguuccaucacuuacaagaaauuccgcgaauauauaaagcugcacgagucaaugaaauucaagagcuugaaauacgacaaggacaacguggaaaguaccaagcuaauugaguuuagaaaacuggucgaguucaagaaagcccucggcgaacauucucuguccagggaggaacuugaucagaucgcaacauacaucacccugauuaaggacaaugagaaauugaagaucacucucgagaaauauagccugaacaaugaacaaauuaagaacuuacuggagauagauuuuaaugaccacaucaaccuaucguucaaggcucucaaucugauucuuccauugaugaaagaagggaagcgguacgaugaggccugcaaacugcucaaccugaagacaaaaucuaauaaccagaaguuugacuuccuucccgcguuuugugauuccaucuucgcccaggaacugaccaauccuaucgugaaccgagcaauuucagaguaucgcaagguauugaacgcucuccugaaaaaguacggaaaaaugcacaagauacauaucgaguuagccagagacauuggccugaguaaaaagcuaagggcuaagaucgaaaaagagcagaaggaaaauuaugagaacaauauuugggcccucaacgaaugcgagaaauuuggucugaaggcaaaugccaaaaacauccuuaaguugaagcuguggaaagagcaaaaggaguucuguauauacagcgggaaaaagaucuccauugaacaccuccgggaugaaaaagcucuggagguugaccauaucuauccauacucucgcagcuuugaugacucauucuuaaauaaggugcuggucuuuacgaaagaaaaccaggagaaacuuaauaagacucccuucgaggcguucggagcaaacgaagagagauggaguaagauucaggccuuggcucaaaaucucccuuacaagaaaaagaacaaaauccuggacgaagccuuuaagggcaagcagcagcaggauuucauauccaggaaucuaaacgacacccguuauauuagcacacugaucgugaaauacacuaaggaguaucucgauuuucugccacuugacgagaaagaagaugugaauuugaagucuggcgagaaagggucaaagauucacguccaaaccaucaacggaaugcugacaaguguuuuacggcacaccugggguuucgcacagaaggaccgaaacaaucaucuccaccaugcccuggaugcuacgauaguggccuacagcacuaacgcaaucauuaaagcguuuuccgacuucaagaaagaacaggagcuucugaaggcuaaauuguaugccaaggaacucacaucugauucguacaagcaccaggcaaaauuuuucgagccguuugagggcuucagagaacaaauccugaaucagauuaacaagcuauuuguaagcaaacccccuaggaagcgcgcccggggagcucugcauaaagagaccuucuauuccaaggacgaaaugaucaagaaauacaauucacaggagggaguggaaauagcccucaacugcggcaagauuagaaaaaucgguacuaaguacgucgagaaugauacaauggugaggaucgacauuuuuaaaaagcagaacaaauucuaugcaaucccaauuuacaccauggauuucgcucuggggguucuucccaauaagauagugaucauuggcaaggacaaaaagggaaacccuaaacaauggcaggagaucgacgaaaguuaugaguuuuguuucucuuugcacaaggaugaccuggucuuaauucagaaaaaggauaugcaggaaccagaguuugccuacuauaauggcuucgacaucagcaacuccucaauaugcguggaaaagcacgauaauaaauuugagaaccucacggacaaucaacgccugcuuuucaccaacgcggaggggaacguaaaggccaaaaagaucgggauucagggucugcgaaucuuugaaaaauacauuaucacaccccuaggcgagaagauaaaggcugauuucaaaccgcgggaagacauugcacucaagacuagcaaaaagcaugggcuguga

SEQ ID NO: 2584 - RNA, 3003 nt, Artificial Sequence
  Cas9 variant
augaagauccugggcuucgacauugggauaaacagcaucggaugggccuuuguggagaaugaugaacucaaagacugcggugucagaauuuucaccaaggcugagaaccccaaaaauaaggaaucccuugcacugccuaggcggaacgcccgaucuucacgccguagauugaaaaggcggaaggcgcgcuuaaucgcuauuaagagaauccuggccaaagagcuaaagcucaauuuuaaagauuacguugcagccgacggcgaacugccaaaggcuuaugaggggagucuugcaagcguguacgagcugagguauaaagccuugacacagaagcucgaaacuaaggaucuggcucggguaauacugcacaucgccaaacaucgcggauacaugaacaagaaugagaaaaaguccaacgacgcgaaaaagggcaaaauucucucugcauuaaagaauaacgcccugaaguuggaaaauuaucaaucggugggugaguacuucuauaaagaguuuuuccagaaguacaaagaaaacacgaagaauuuuaucaaaauucgaaacaccaaggauaauuacaacaacugugucuugucaagcgaccuggagaaggaacuaaaauucauccucgagaagcagaaagaauuuggguauaaguacagugagggauucauaaaugagauucugaaaguggccuuuuuccagagaccgcuuaaggauuuuucccaccugguuggcgcuugcacauucuucgaagaggaaaacagggcauguaaaaauucuuauagcgcuugggaguuuguggccuugacuaaaaucauuaacgaaaucaagucccucgagaaaaucucaggcgagauugucaguacccaaacaauaaaugaagugcugaacuuaauccuggacaaggggagcauuaccuacaaaaaguuccggucuugcaucaaucuccaugaguccauaucauuuaagagccuuaaauaugauaaggaaaacgcggagaaugccaaacugauugacuuccguaaguugguagaauuuaaaaaggcacuaggaguucacagucugucucgccaggagcucgaucagaucuccacucaugugacacugaucaaagacaacgucaaacuuaagaccgugcuggagaaguacaauuugagcaacgaacagauuaauaaccuccuggagaucgaguucaaugacuauauuaacuuaucguuuaaggcucuggguaugauacuaccccucaugagagaaggcaaaagguacgaugaggccugugaaaucacgaaccugaagccuaaaacuguggacgagaagaaggauuuccuuccagcuuuuugcgacucuauuuucgcccacgaauuguccaaucccgucguuaaccgggcaaucucagaguaccgaaaagugcugaaugcccuccugaagaaauaugauaagguacacaaaauccaucuugaacuggcucgcgacgugggguugaguaagaaggcgagagagaaaauugagaaggaacaaaaagagaaccaggcagucaaugccugggcucucaaggaaugugagaacauaggacugaaagccagcgcaaagaauaucuuaaagcugaaacuauggaaggaacagaaagagauuugcaucuacuccggcaacaagauuucuaucgagcaccucaaagaugaaaaggcccuggagguggaccauauauauccuuacagcaggucauuugaugacaguuucaugaauaaaguucuuguguuuaccaaggaaaaccaggagaaguugaauaaaacaccauucgaggcuuucgguaagaacaucgaaaaaugguccaagauucaaacucuggcccagaaucuccccuauaaaaagaagaacaaaauccuggaugagaauuuuaaggacaaacagcaagaagacuucauuagccggaacuuaaacgauacccgcuacaucgcaacacugauaaccaaguauacgaaagaguaccuuaauuuucuuccucucaacgaaaaugagaacacuaaucugaagucuggggagaagggaucaaaaauucacguccagacagugaacggcaugcuaaccaguguacugagacacacuuggggcuucgacaagaaagauaggaauaaccaucuccaccaugcgcuggacgcuaucauuguugccuacagcacaaauuccaucauaaaggcauuuucugauuucaaaaagaaccaggaacuuuugaaggcccguuuuuaugcuaaagagcugaccucggacaauuacaagcaccaggugaaauucuuugaaccauucaagggguuucgggagaaaaucuuaagcaagauugaugaaaucuucgucuccaagccgccccgaaaaagagccaggggagcacuccauaaggagacguuuuauucagaggacgaaaugauuaaaaaguacaacaguaaagagggucugcaaaucgcucuuucuuguggccgcgugcggaagauagggaccaaauaugucgaaaaugauacaauggugagaguugacauuuucaagaagcagaacaaauucuacgccaucccuaucuaugcgauggauuuugcccugggaauuuugccaaauaagaucgugguagucggcaaagacaagaacaacaaucccaaacaguggcagacuauugaugagagcuacgaguucugcuuuucccucuacaagaacgaccugauaaugcuacaaaagaaagacaugcaggaagcugaguucgcauauuacaaugguuuugauaucucaaccagcucuauuuguguggaaaagcacgacuccaaauucgagaaccugacaaguaaucagaagcuccuguuuagcaacgccaaagaagggucuguuaagguggagaaucuuggcauccagaacuugaagauuuucgaaaaauauaucauaacuccucugggagauaagaucaaagcugacuuucaaccaagggagaauauuuccuuaaagaccucaaagaagaacggccucuga

SEQ ID NO: 2585 - RNA, 3003 nt, Artificial Sequence
  Cas9 variant
auggccagagcucagaggcggcugaucagccgccgagcaaaccguaugaauaagcucagaaggcuucugaaacaagagaacguguugcaggccaaugacuacgaugaaaagggcuuaauuauagggcugcccaaccaggcgugggagcuacgggcucagggacucgaccgcaaacuggaaccuaaggagugggccgcaguccuuaucaaucugguuaaacacagagguuauuugucccaaaggaagaacgaaucucagaccgccgauaaggagcucggcgcucugcugucagggaugaaucauaaccaccagcucuuacagagucaaagcaaucaguaccggacaccagcagagcuggccauuaaacaguucgcuacucaggacggacauauccgcaaccaacgaggcgccuauacgcacaccuuuaauagacuugauuugcagaacgaacugaaucagcuauucgacgcgcaaacaaggcucgguaacccgcauguguccgggucucugaagacugcaauuaaugaucuucugaugaaccagaaagccgcuuugucgggagacgccauccucgagaugcugggccggugcaccuuugaacccucagaguacaaggcagcuaaaaacacauauagcgccgagcguuucguaugguuaggcaagcugaccaaucuccgcauacaggauaacgggcuugaaagugcgcuguccagagagcagagggaauugcuacugaaugagccuuacaacaagacuaaacucacauaucaacaggugcggaagcugcuucgacugccagaaaccgccuuuuucaaaggauugcgcuacgguaaggacaaugcagagucugcuacguuuauggagaugaaaagcuaccacgccaucagaaagucccucgaaaacaaaucacugaagagugagugggaaaaguuaaaaacucagcccaagcugcuagaucucauuggcaccgcuuucagcaucuauaaaacagacgaugagauugccgggugucugaagaaucagcuuccugaaaacgucaucauagcauugcaagagcagcugaauuuuucuaacuucauggagcucucccugaaagcccuugaaaagcuguugccacucauggagcagggacugagguacgacgaggcuugcacucagauuuauggcaaucggcacgaaaagaucgcggacaaaaccgaaaaguuuuuacccaacauuccugcagauaaacugcgcaauccagugguucuaagaacacucacccaagccaggaaggugaucaacgcuaucauucgucgguacgguucaccggcccgaguccauauagagacggggagagaggugggaaagagcuucagugacagggauaagcugaagaaacagcaggaagagaaucaggaacaacgccggagagcaaucgacgaguggaagcaguuuuuccccaacgccgcucacgagccuaaagccguagauauucuuaaguugaggcuguaucagcuccaacagggcaaaugucuguacucuggcuuaccaaucgacguucgccgacugcccgaaaagggguauguggagauagaucaugcacuuccuuucucccggacuugggacgauagcuuuaacaauaagauuuugguccucgcgucggaaaaccagaauaaaggaaaccagacaccauacgaguaccugcguggugcugacaauucugaauccuggagacuauucguggagaacgugcaaaauugccaguuuucacccaacaagaaacagaagaucauggccaaacagcuggaugagaagggcuuccucgaaaggaaucugaacgacacccgcuaugucagucgguuucuuugucaauucaucagcgagcacuugcaccugacugggaaaggaaagaagagaguuuuugcauccaauggccagauuacagccuuacucaggggucgaugggggcugucuaaaaaccgcgaagagaaugaccggcaucacgcuguggaugccguaguggucgcaugcagcaccguggcuaugcagcagaagaucacgcaauucguuagauaccagaaaggcaacguguuuaccggagaaaggauugacaaggagacaggcgaggucauaucaauccauuucccgacuccuugggaacacuuucgugaggaagugaugauucgcguauucgaugacaauccccuucggacccugccagagaaauugccuaacagacccgaagcccuccaugaguauguuaugccacuguuugugaguaggaugcccacacgaaagaugacugggcagggacacaaggagaccaucaaauccgcgaagcggcuagaugagaaaaucagcguccugcgcgugccucucacacaacugaaacuuaacgacuuggaaaauauggucaacagagaaagggagccagcccuguacgaggcuuuaaaagcacggcucgaacaguucaagaaugauccggccaaggcuuucgccgagcccuuuuucaaacaggguggccagcaagugaaggcaguucgaguggaaauuguacagaaaucugggaugcugcuuagaaagauaaacggagucgcggacaauggcucaauggugcgcguugauguguuugagaaaagugguaaguucuaucuggucccuaucuacgccuggcaaguggcugaagggauucuaccaaacuaugccguaguggcacacaaggacgagagcgauuggauccucauggacgaguccuaccauuuuaaauucgcucuguacaagaaugauuugcuggaaguucagaccaaaaagggcggaauuaugggcuauuuugccucuuuagacagggcaacuggggccaucacgauacgugagcacgaccgggauaaaaagaaauguaaggacggagaacauagaucgaucggugucaagauggcuagcuccuucaaaaagcuccagguggaugagcugggcaaaaacauucacgaaacaaggucacgcaagcgacccaauaucggguga

SEQ ID NO: 2586 - RNA, 3012 nt, Artificial Sequence
  Cas9 variant
augagaauccugggcuucgacauugggauaaacagcaucggaugggccuuuguggagaaugaugaacucaaggacugcggugucaggauuuucaccaaagcugagaaccccaagaauaaagaaucccuugcacugccucggcgcaacgcccgaucuucacguagaagguugaagcggcgcaaagcgagauuaaucgcuauuaagaggauccuggccaaggagcuaaaacucaauuacaaggauuauguugcagccgacggcgaacugccaaaggcuuacgaggggagucuugcaagcguguaugagcugcgguacaaagccuugacacagaaccucgaaacuaaagaucuggcucgcguaauacugcacaucgccaagcaucgaggauauaugaauaagaacgagaaaaaguccaaugacgcgaaaaagggcaaaauucucucugcauuaaagaacaaugcccugaaacuugaaaacuaccaaucggugggugaguauuuuuacaaggaguucuuucagaaguacaaaaagaauacgaaaaacuucaucaagauuagaaauaccaaagauaacuauaacaauugugucuugucaagcgaccuggaaaaggagcuaaagcucauccuggaaaaacagaaggaguuuggguacaacuauagugaagauuucauaaaugagauucuuaaaguggccuuuuuccagaggccgcugaaggacuuuucccacuugguuggagcuugcacauucuuugaggaagagaaacgggcauguaagaacucuuacagcgcuugggaguucguggcccucacuaagaucauuaaugaaaucaaaucccuggaaaagaucucaggcgagauuguccccacccaaacaauaaacgagguguuaaaucugauccucgauaaaggcaguauuaccuauaagaaauuccguagcugcaucaaccuucaugaaucuauauccuuuaagucacugaaguacgacaaagagaaugcggaaaacgccaaguugauugauuuccgcaaacugguagaguuuaagaaagcacuagggguucacagccucaguagacaggaacuggaccagaucucuacucauaucacacuuauuaaggacaaugugaaacugaagaccgucuuggagaaguauaaccucuccaaugagcagaucaacaaucuguuagaaauugaguucaacgauuacauaaaccugagcuuuaaagcucuaggaaugauccucccucugaugagggaagguaagcgguacgacgaggccugugagauugcuaaucuuaaaccaaagacgguggaugagaaaaaggacuucuugcccgccuuuugcgauucgaucuucgcacacgaacugucuaacccuguggucaaucgagccaucuccgaauaucgcaagguucucaacgcucugcuuaaaaaguacggcaaagugcacaagauucaucuggaguuggcgagagacguagggcucaguaaaaaggcaagggaaaagauagagaaagagcaaaaggaaaaucaggccgugaacgcuugggcccugaaagagugugaaaauaucggauuaaaggcaucagccaaaaacauucugaagcuaaagcucuggaaagagcagaaggaaaucugcauuuauagcggcaauaaaaucuccauagagcaccugaaggaugagaaagcucuugaagucgaccauaucuacccauauucucggagcuuugaugacucauucauuaacaagguguugguuuuuacuaaagagaaucaggaaaagcugaacaagacccccuucgaggccuuugguaaaaauaucgaaaaguggaguaaaauucaaacacucgcacagaaccugccuuacaagaaaaagaauaagaucuuagaugagaacuucaaagacaagcagcaagaggacuucauaucccgcaaccugaaugauacuagauauauugcgacccuuaucgcuaaauacacaaaggaauacuugaacuuucuccugcuaagcgagaaugaaaacgccaaucugaaaucuggggagaagggaucaaagauucacgugcagaccaucaguggcaugcucacgagcguccugaggcacacuuggggcuucgacaaaaaggaucguaacaaucaucuucaccaugcauuggacgccauaaucguggcuuauuccacaaacucuauuaucaaagccuuuucggauuuccggaagaaucaggagcuguuaaaagcacgauuuuacgcuaaggaacucaccagcgacaacuauaagcaccagguaaaauucuuugagccauucaaguccuuuagagagaaaauucugucaaagaucgaugaaauauucguuaguaaaccgcccaggaagcgcgcccggagagcgcuucauaaggacacuuuucacucugaaaauaaaauuaucgauaaguguagcuacaacuccaaagaggggcugcaaaucgccuugucaugcggaagggugcgcaagauugguacaaaauaugucgagaaugacaccaucgugcgagucgauauuuucaagaaacagaacaaguuuuacgcuauaccuaucuaugcaauggacuucgcccucggcauucugccaaauaagaucgugauuacggggaaagauaagaacaacaaucccaaacaguggcagaccaucgacgaaagcuacgaguucuguuuuucucuauacaagaacgaccugauacuccugcagaaaaagaauaugcaagaaccugaguucgcuuauuacaacgauuuuuccaucaguacaagcucuauuugcguugaaaagcacgacaauaaauucgagaaccuuacuuccaaucagaaguugcuguuuucaaacgccaaagagggaagugugaagguagagagcuuaggcauccagaaucucaaagucuucgaaaaguauauuaucaccccacugggugauaagauaaaagcagacuuucaaccccgggaaaacauuucgcuuaagacauccaaaaaguacgggcugcguuga

SEQ ID NO: 2587 - RNA, 3012 nt, Artificial Sequence
  Cas9 variant
augaucgacgagagccugaccuucggcauugaucucgggauaggauccugcgguugggccgugcuuagaaggcccucugcuuuuggccggaagggggucaucgaaggaaugggcucaugguguuucgacguuccugagacaaguaaagaacgcacuccaacgaaccagauucgacguagcaauagacuguugaggcgggugauccgcagaaggcggaaccgcauggcagccauucgaagauuacugcacgcggcuggucuacucccguccaccgauucugacgcccugaagaggcccgggcaugauccuugggagcuucgggcacguggacuggacaaaccauugaagcccguagaauuugccgugguccucggccacaucgcuaaacgcagaggcuucaagucggcagccaagaggaaagcuacaaauauaucaagcgaugacaagaaaaugcugacugcccuggaggcgacccgggagcgacucgggcgcuacagaacagugggagaaauguuugcaagggauccugacuucgccagucggcgcagaaacagggaggguaaguaugaucguaccacugcucgggacgauuuagaacaugagguucacgcccuguuugcagcucaacgaagacuuggccagggguucgccuccccagaguuggaagaggcguuuacagccucugcauuccaucagaggcccaugcaggacagcgaacgccuggugggauuuugcccuuucgagcggaccgaaaaacgggcugccaagcuaacgccauccuuugagagguuccgccuccuggcucgacuucugaauuugcggaucacuaccccggacggcgagcguccccucacagucgaugaaauugcccuggugacuagagacuuagguaagaccgcaaaacugucaaucaagaggguacgcacacucauugggcuugaggauaaccaacgguucaccacgaucagaccugaagacgaggauagggacauaguugcccgaacuggaggcgcuaugacaggcaccgcgacucugcgcaaagcauugggggaagcccuauggacagauaugcaggagcggccagagcagcuggacgcuauugugcagguccucagcuuuuucgaagccaaugagaccaucacggaaaagcugagagagauuggacuuacccuggcaguguuggaugugcuccugacagccuuagacgcuggugucuuugccaaauucaagggcgcagcgcacaucagcacuaaagcugccaggaaccugcuaccccaccucgaacaagggcgucgcuacgaugaggcauguaccauggccggauaugaccaugcugccucucggcugucccaccauggccagaucguugcaaagacacaguuuaaugcucuugugacugagauuggugaaucaauagccaacccuaucgcgagaaaggccuugauugaggggcugaaacagaucugggcuaugaggaaucacuggggccucccaggaagcauacacguagaacuggcacgagacgugggcaacaguauugagaagcggcgcgagaucgaaaaacauaucgagaagaauaccgcccuuagagcuagggaacggcgagagguccacgaucuguuggaccucgaagaugugaacggggacacacuguuaagauaccgccuguggaaagagcaaggagguaagugccuauauaccggcaaggccauucauaucaggcagauugcagcgacugauaauucuguucagguggaccacauacuccccuggucccguuucggggaugacagcuuuaacaacaaaacgcugugucuugccucggcuaaucaacagaagaaacggucuacaccguacgagugguuguccggacagaccggcgaugccuggaacgcauucguccagagaaucgaaacuaauaaggagcugagggguuuuaaaaagcgcaacuaucuccugaagaaugcuaaagaagccgaggaaaaguuccgaucaagaaacuuaaaugacacccgguacgcagccaggcuguuugcugaggcggugaaacuuuuguacgccuucggggagcgccaagaaaagggcggaaaccguagaguauuuacacggccuggcgcacucaccgcugcccugaggcaggccuggggaguugagagucugaaaaagcaggaugggaagcgcauuaaugacgaucgacaucacgcucuagacgcacucacuguggccgcggucgacgaagcugagauccagagacugacaaaaaguuuccacgaaugggagcaacagggucuuggccggcccuugaggcgcguggagccaccuugggaauccuucagagccgaugucgaggcaacguaucccgaaguguuuguugccaggccagagcggcgucgcgcucgaggggagggacaugcagccaccaucagacaggugaaggaaagggagugcacucccauuguauucgaacggaaagcggucucuagccugaaggaggcugacuuagaacgcauaaaagauggcgagagaaacgaggccaucguggaagcaauuaggucauggaucgccacaggucggccugcugacgccccaccgcgaagucccagaggggauauuaucaccaagauacgccucgcaacaacuaucaaagcugccguuccugugaggggcggaaccgcgggcagaggggagaugguccgugccgacguguuuuccaagccaaauagaaggggaaaggaugaaugguaccugguacccguguauccucaccagauuaugaaccgcaaagcauggccaaagcccccgaugcggagcaucguugcuaauaaagacgaggaugaauggacggaggucggcccugagcaucaauuccgauuuucucuuuacccaagaucaaacauugaaaucauaaggcccaguggugaggugauugaaggguauuucgugggacugcaccgcaauaccggcgccuugaucccuacacccgucgguccagacagcuacguuauugcuuga

SEQ ID NO: 2588 - RNA, 3024 nt, Artificial Sequence
  Cas9 variant
augaaggugcugggcuucgacaucgggauuaacagcauaggaugggccuuugucgagaauaacgaacucaaagauugcgguguuagacuuuucaccaaggcugagaaucccaaaacaaaggaaucccuggcauugccuaggcggaacgcccgaucuucacgagugcguuuaagaaggcggcgcaguagacugcuaagccucaaacacaucauuuccaaggaguuuggccugcauuacgaagacuauaucgcgcuugaugggaaucugccaaaggcuuacacuggaaaaauugagucuaucuauaaguugagguacgaggcccucucgcaggcaauaucaaaagaagaccuggcccggguaauccugcacauugcuaagcaucgcggcuauaugaacaaaaaucaaaagacgagccaggauagugagaagggugcaauccucuccgccauuaaagaaaacucuaauaagaucaaacacuaccagaccgcuggggaguauuucuacaaggaguuauuugaaaaccugcgagacggaacaaaagaguucaagaauauaagaaacaaagccaugaagaaugaaaagacuggcaacauggagagcaccuacuauaauacaauucuugcguccgauuuggaaaaagagcugaagcuaauccucgagaaacagcaagcauaccauaacuauucagacaccuuuauuaaggaagugcuggagaucgccuucuaccagaggccgcuuaaagauuuuagucaccuggucggcagcuguacuuucuaugaaaacgagaagcgggcuugcaaaaauucuuacuccgccugggaauuuaucgcauuggggaaaauuauaaacacacucgagucaaucaagaaagacaccggagagauuuucagcaaugaaaucauaacgcagauucugaaggagguguuagauaaagguagucugucuuauacuaagcuccguaagaugaucaaccuugacgaaaaaguuaaguuuaaaggccugaaguacgauaaagaggggguggaaaagaccaauuugaucgaguucaagaaacuaaaggaguucaaaaaggcucugggagaacacaaccucgagcgcaaaacacuggacgaaauugccacucauaucacccuuacaaaggacgagaaucagcugaaaaagcaauuggagcaguacgcgcucucccagaaccagauugaugcccuggcagaauuagacuuuaaugaucacauaaaccugagcuucaaggcucuauaugagauccucccccugauggaaaaaggcaagagauacgacgaggccuguaaugaacuugguuugaaagcuaagaccucgaaccaaaaaucugaguuucugccugccuucugcgauuccauuuuugcacaggagcucacgaauccaaucgucaacagggccaucucagaauaucggaaggugcugaaucgacuucugaagaaauacgggaagaugcauaaaauucacauagaguuggcucgcgacgcgggacucaguaaggaagcaagaaacaaaaucgagaaggaacagaaggagaacaaagauauuaaugacaaggccgagaaaacuuguaaggaguucggccugaaacccaacgcuaagaauaucuuaaagauuaaacuguggagggaacaaggcgaaaucugcgccuauagcgggaagaaaauaacaaucgaugaccuaaaggaggauaaagcacucgaaguagaccacauuuacccuuauucccggucuuacgacgauagcuacaacaauaagguucugguguuuaucaaagagaaccagcuuaaguugaaucagaccccauaugaggccuucggaucaaaccaggaaaaguggaguaaaauucaaguccuggcucagaagcuccccuacaaaaagaaaaaucgcauccuggacgagaacuuuaagaauaaggaucagauagaguucauuuccagaaacuuaaaugacacuagguaugccacaagccugaucgcaaaauacaccaaggaauaucuugaguuuuugccucucucugaugacgaagauauuucacugaaaaguggugagaagggcagcaaaacgcaugugcagaccaugaacgggaugcuaacauccgugcugcgucacgcguggggauucucucaaaaggaccggaauaaccaucuccaccaugcucuggaugccaucauaaucgcauacucgacuaacagcauuaucaaggccuuuuccgacuucaaaaagaaucaggaaauucuuaaagcuaaguuguaugccaaaaagcugaccucagaggaauacaagaaccagaguaaauucacaggcuuugagaaguaccgaucuaaaaucuuagagaagcucgauagcauauucgucuccaaaccaccgaauaagaacacuaagggugcacugcacgaacagaccuuuuauucauaccaagacauucuugaggaauauaaaacacaggaggggcugaagagagcuuuggaauguggcaaaguuaggaagaucggaaccaaauacgugguaaaugaucgcauggugcggcucgacaucuucaagaaagacaacaaguuuuauggcauucccaucuacacuauggauuucgcccuggggguccuaccuaauaaggugguuacgauuggaacagacaaagauaagauaaagaaggaguggaaaaccaucgacgagacuuaugaauuuugcuucagccuguacaagggugaucucgugcugauucagaagaaagagaugcaggaaucugaguuugcguacuauaacggcuucgacaucuccagugccagcauuucucuugaaaagcacgauaauaaauuugagaacuugaccgagaaucaaaagcuguuauucccaaaagcuaaggaaggggacgucgaggugagaggaaucggcauacagggucucaagguauuuaaaaaguacaugguuacaccccugggggaaauccaggagaccaggacugaggcacgccaaaacauucagccucgcaaaaagcauggccuucgguga

SEQ ID NO: 2589 - RNA, 3033 nt, Artificial Sequence
  Cas9 variant
augagcgacuccucuuacgugcugggccucgaucuugggaccaacucaaucggaugggccugcgucagacugaauaaggguaaacccgacggcuuguuagcucaggggguuaggauuuucgaggcaggacuggaaauagaugccuauggccgggguacaccucuaaacacugagcgccgaaaugcgcgucaaagaaggcggcuccacgaccgcagaaagaggcggauccugaaagugcgccgaauccuucaggaagcugggaugcugccagccaacaagccggaucauaaagacgcagaguggaagauguugcucgccagaaaucccuacaggcugcgggcuaaggcacuggaugaacagauugaccucaaagagauuggauuauguaucuaucaguuugcccaccgucgcggcuuccugaguaacagcaagauacuuaaaaaggaugacgauagaggcaaauugaaggacgcuacgaaggccuuugcggaggauauggaacaaaaaggggcaaggaccuggggagaguaccugucccaucuagacccucacgaacagcggauccgaacaaauuauacucuccgcgagugguacaccucugaguucgaccugauuugggaaaagcagcagucguuuuauccacauguacuuacagaugaccuguacaaaagagugaaggaggccuuguucuaccaaaggccccucaaaucacaggcucaccuguuaggucagugcgaacuggagccuggccggaagcgcgccccauuugcacuccuuauggcucaggaguucagacuguugcaaagccuaaaccaccugagggucgugaguuccaccggggaugaacgucuccugacugacgaggaacggaaacaggcccuugcgcuguugcgaucuagaggaaaucagaaguuuacaacccucaggaagguucugaacuuacgcggcacgaaauucaaucuggagcgggguggggaaaagacuauccaaggaaacaauaccgccgcagcucuaggcaaccucuuuggcgaggccugggaucauuucagcuccgaacagaaaaaucagauuguggaggacagacugacaaucggggauacugacgcucuuauaaggcgcaugaagaaaaccuggggauuggauucagucacagccgagauguuuagugaaaccgagcuggaagacgguuauuguggcuucagccgaaaggcacucgagaagcugcuuccccuguuggaacgggggcacgcccucauggaggcugugcaggcggcauacccugauuaucaaaagaaccugccacguacggacacuuuaccgccccuggagaaccuaagaaauccuauuguacagaggacacucucugaacugcgccggguugugaacgccaucauuaaggaguacggaaaauccgacaagaucagaaucgaacuugcuagggauaugaaacagaccgccaagaaucgagagaagucaugggaccgcaugcgggucagagagaggcagcguaaagaagcagccaagaaaauuuuggaggaaacuggcaacccagcuccccgccggcaugagauagaaaaggugcugcucgccgaggagugcaauugggaauguccuuauacagguaaaagaaucugcaugaacacccuguuaggggaugcaccacaauucgacauugagcacaucauacccuuuagcaggaguuucgauaauucuuuuuccaacaagacgcugugugacgugaauuacaaccgaaaugucaagggcaacaaaaccccguaugaaagcgcgucggagacagaacacgaggagaugguuugccgggugaagcgcuucacuggagauuacaaagaaauuaaacuugacagauuuaauaccagggagacagauucucgggcugacuucaucgaagaguuuuccacuucacaguugaacgauacccgauacgccaguagacucgcaggcgaauaucuggggaaacuauacggaagcgaguggcgcaagcauauccagauugccaaagguggcacaaccaaguaucugagggacgcuugggaucucaaucguauccuguccgacgggggaacuaagucucgggacgaucacagacaucacgccguagacgcaguggucguggcucuuacgacaccucagaccguuaaagccuugagcgaugcgaaccaaagggcccccgagcaucgccgauacgcuuucucagacaugccacugccuugggaaacuuuuagacaggauguggagcaggcaauuaacaguauaaccgucucccacaaggugugucggaaagccaauggccaguuacacaaggaaacauucuauggucucaucaaagacaggaagaccggggauacucgcacaguacugcguaagccccuucaugagcugacggacaaagagauuaagagagcugaaaucguugauagcucuauccggaaauugauugagcaaaagcucaaagaccuggaucagccacccaagaccgccuuuaaggacaggaacaaucacccuuucauaaucgauaaaaacggcaauaagcgcuuuauucauaaagugcgagucuaccaggacgcaaagccagugaaaaucgcggaaaacagacacgucaagcuaggaggcaaucaccaucuggagauuuucgaagugaucgacaagaaagggaacccgacuuggaagugcgagguuauaucacucuucgauacacggcaaagggugaaagagaagcgccccguaaucgucagacaggaccagaauggaaacccucugaaauuuagucuuagcauuggugaagccgugcaguuggauuggaauggcgggagggagaccgcuguugugcaaaagauguccaaaacaccaaacacugucgaauauguguuccggaagcacaaugacgcccguaaggcagcugauauccccuacaaagagaccauuacgguaaagucugacucggcccuguuugcaagcaacuuacagaaaaucgugauaaccccuacaggacucauucgccgagccaaugauuga

SEQ ID NO: 2590 - RNA, 3033 nt, Artificial Sequence
  Cas9 variant
augaagaacagaaaugugaucggcauugacgucgggaccaacagcauaggaugggcccugguugaggaaaaugagaacggucucccccagucccuuaaagcugcaggcgugaggaucuuccaagaagccguagaggcgaagacacggacuccuaaaaaucacaagcgccgacaggcucgucuggccagaaggguguuggcacggcgcgccagaaggaaacagcgguuacagaaccugcuacucaagcaugggcugcuuccaggaggcgucacggauccggugcaacgcgaagcugcauuuaccacacugggugaccccuaccaguugcgagccaaggggcucaaucugccucugggacuccacgaguucggcagaguuuuauuucagcugggcgcuaggcggggguuccuuucuaaccguaaaacucgcuauggacauuugaauaagcuggaugagcuagccgaccucauugaagcggaggaugcagccccaaaaaccggugacgcugaagagggcaucauuagaaaggagaucggggaacugaggcaggccaugucagcagcuggaagucggacacuuggcgaguaccuggccgguuuggcgaaagaggaacgaaagcgcugcagacacaccgaaagggccaugcucgaggaggaauuugagcggcuguggauggugcaagcacgcuuccaucccgaauuaagcgaugagcugaagguccaggugcacacuguaauauuuuuccagagaccucucaaauccaacagggcuucucuugggaaguguucgcuggaaccaucacgucggaaagccgcucgagccuggcccgaggcacagagauuuagguugcuacaagaccugaauaaccucgagauccuggauccucgcacaggagaacuucggagacugagggacaccgagcgcgccauuuugcucaaugcucuggaacagcagaagaguaugacguggaacgcgguucggaaaaaguuaggccugcaccaaggcgagaaauucaaucuagaaacuggggcaaaggccgagaccggacucaagggucugcagacacuugcuaguuugcaugccauccugcagggcugguuugaugagcucggggacaaacgggaucugcuuauugaagaccugaucacuauagaggacuccgcaggauuguaucguagacucagggaacacuggggcuucgaucgcgagaccgccuuucggcuggcuacauuagagcuggaaccagguuacgccucucuaagccucaaggcaauuagaaaacugcuuccgcauaugggggcgggccacagguauuccgaggcucgacagcaagugggauacggcuaugaaaccgggcagcgcgacuugcaggagcggcugggagaacccccugauccaagaaaccccgucguggacaaggcccuccacgagcugaggcgugugaucaacgcauuaauucaucgcuucggucggccugaugucguuagaguggagcuggccagggaccuuaaauuggcuaagcgagauaaggaacggcucgagaaacagaaucgcgaaaaccaaagacugaauaggaaggccgaggcagcucuagccgaacugggccucgggcagccaucacgggacgaucugaucaaauaccgacuuugggaggagaguaagggauugugccccuacacgggcagagaaaucggucugagcacuuuauucucuccggagguagacguggaacacauuauaccuuauucccgcugucucgaugacucauacaugaacaaaacacugugcaugaccgaggaaaauaggaugcagaaggggaaccguacucccugggaggcguauggcggagacccagcccgguacgagcagauccuucaaugugcuagauauuuuccuauggcaaagaggaaacgcuuccuggaacagggcagcgauuuugucgaccaguucauucagcgacaauugaaugauacaagauacaucgccaagcucgcuaaagaguaucuggccgcagugugcaccaacguucaggugacgaaagggggaaccacagcgaugcuacggcaucacuggggucugaauaggcuccugggcgaagacgaugggcagaaggagcgcggagaccaucgucaccacgcccuugaugcugccgucauagcagugacuagcagaucuuuguaccaacggcuggcuaggauugcccaucagcgcggccacgcacccucccagcgagguuuuuacaucgacccacccuggcagggguaucaagccgauuuagcucagacccucgcgggcaucguaguuagccaugccacaaacagaaagcugacuggagcacuucacgaggaaaccgcuuacggccacauuccucaugugggguucgucuaucggaagacacugaauaaagacuuuaagcuaggagauaucgaggccauuuacgacccaucgcuccaggaacuggugaaagcccacuuggagcaucacggcaacgauccgaagagggcuuucgcagaagguauacaguguuaucauaaagacgggcacacccccaucaagcgcgucagaauuagggccaaacaagugucugagaagggaacuuuuuccaucucagaccgggcgggccgugcuuacaagcaccauaaaacggguaguaaucaccauguugagauccugcgccaccgagccacaggcaagauugaaccuguguauuuaaccacuaaagaggcaaccgaaagagccaggcgagggggagagccaguaauacagcgcgaucauggccccgaaugggaguucaucauuagccucugcaucaacgacauggucagacugggggagggaggccagguggcuuacuuuaggguucagaagauugaagcaacaaauaaccgggugacccuucgaucccaccuggccgcgacuuuggaugacgaggauaugaaagucacaacgucugugccuaagcucgcuguaaugccagguuuccaaaaggugcugguuaccgccgucggggaagugcuagagcugcacgacuga

SEQ ID NO: 2591 - RNA, 3033 nt, Artificial Sequence
  Cas9 variant
augaagagaauggccgcugugggccugaugcccgcagacccuaccgaggccaaagcgcucgaacuucuggauccauacgcuuugagggccgcaggguuagaccaggcccugccgcuaacacacuucggacgggcucucuuucaucugaaccaacgccgagguuucaagagcaaucguaaaacugauaagggcgacaacgaguccgggaaaaucaaggaugcaacgaagagacuugacgaagagauggccauuaaaaaugcuaggaccuauggagaauuucugcacaugcggcgcacaucugccacugaucccaagaacgucccuaccguuagaacaagguugucaauagcgcggcgcgacaaugcagagaaagaggaagccggcuacgauuucuauccagaccgaagacaucucgcugaggaauuugauaagcuguggaaagcccaggcagguuacagucccgacgugcugaccgaugagcucagggacgagaucagcguaauuaucuuccaccagcggccuuuaaagacuccagaaguggggcugugcuuguuuuccggaucucauggcguccccaagaaagacaagcguauuccuucggcucacccacuuaaccagcgcagaauccuguucgagacaauaaauaaccuaaggguggccgcgcggggcgaaccggcccgagggcucacccgcgaugagagagacgcaaucguucacgcucuggauaauaaagcccauacgaagucacuuagcggaaugaguaugaaacugaaggcuuuggguaaagugauuaagcucaggcccgaacaauccuuuacucugcagaccgccaaccgggagacaaucgcaugugacccuguccgcgccucuuuaagccacccagauagauucggccccaggugguccaugcuggacgcugaugcgcagugggacgugguacagcguauucgggcaguucaaucagaggccgaacaugaugcucucgugaaguggcuuauggccacucacgggcuggaccgagaucacgcagagaguaccgccaaagcuccuuugccagaaggauauggcagacuaggucugacagccaccaagaggauccucgcagcgcuggaggcugacgucauacccuacagcgacgccgugaaagcaugcggguggcaucacucugauggacgcacgggcgaagugcuuacugagcugccguauuacggccagauuuuggaccggcaugucaucccugggacauacaaugaguccgaugacgauguuaccagauauggaaggauuacuaaccccacagugcacaucggucucaaucagcugcgccgauuaguaaacaagaucauuaccguguacggcaaaccagacgaaauagucguggagcuggcccgggaucuaaagcucucagaagaccagaagcgugauguucaaagagacaucaaaaagaauacggaugcugccauugcacgcggggcuaaacugagcgagaugggagugccugacaccggcgccaacaggaugguccuucgguugugggaaagucugggugaugacgugaugacaagaaacugucccuauucugggaagaggaucuccgcgacuaugcucuuugacggcagcugcgauguagaccauauacugccauacucgcgaacccuugaugacggauucgccaaucgcacacuguguuugaaagaguuuaaccggcagaagacugauaagacccccugggaggcuuggggcgacaccccugcaugggccacaauugaagcuaaucucaaaaaccugccagccaauaaggcauggagauucgcgccggaugccauggagagguucgaaggggagaacgacuuuacuucucgugcuuuaaaagaugcccaguaucugucccgcaucgcacggacguaccuagacgcucucuaugauggagccgacgguaagucacacguuugggugguccccggcagacugacagagaugcuuaggcgacacuggggguugaauagucugcucccugauaaagacggagcagugaaggccaagaaccggaccgaccaucgccaccaugcuaucgaugcggccgucguggcagcuacugacagaagccugauucaaaggaucuccaaaauggcccggaaggaugaaguuaauggcgccgaggaaguggcucgaucuguaccacccccuugggaggguuucagaaccgacauugaaacacaguuagaucgcauaaucauuagccacagggcagaccacgggcguaucgauccagccgcgcggaaagacggccaugauucaaccaguggacagcugcacaacgacacugcuuacggccuuggggagggaaauuccgucgugagcagaaagcccuugcucucucugaaaucaaacgauaucgagguuacaacgaagggugccaauauuagggacguggaccuacagcgccaucuggaacgaauaaccagaggccucgaugggaaagcacuggaggccgcucuugcagaauuugccgcgacugcuaaguugccggacggaacagauaacccuuacuauggccugcggaggguccgcuuagaggaaacccuccaacagggugcccguguggagguaaaggacagaaaugggaaaccauucaaggcauacaaaggcgauaguaaccacugcuaugagaucuggcggaugcccgacggaaaggugguuccucaggucauuacaacuuacgaagcccaucagaucgauguggagaaaaagccccacccagcugccaagaggcugcuucgcauuuuuaaacgagacaugguggcaaucgaacaagaugacaaggcuauaaucggcuauguccagagcaugcacguugccaacgggcuguucauugcgccucauaccgaggccaaugcagaugcuagaucccgggacaaaucugauucguuuagguugauccagaugagcgccggaccccucgugaaggcuaacgcacgcagaguguacguagacgaaaugggcaggcugcgggacccaggugccccguccuga

SEQ ID NO: 2592 - RNA, 3039 nt, Artificial Sequence
  Cas9 variant
auggccaacaugagauacaggcuggcucucgaccuuggcagcaccucccuggggugggcaauggugcgguuggaugcccagaaugagacaugcgcggucaucaaggcuggaguucgcauuuucucugacggucgaaaccccaaagauggcucaaguuuagccgugagccguagagaagcaagggccaugcggcgcagaagggaccggcugcuaaagcgcaaaacucgaaugauggcuacgcucaugaagcacggguuuuucccucaagaugaggcagccagacaggcucugguaaauaaagaaccauuugcccuuagggcgaagggacuggaccaugcauugcucccggaggaguucgcccgggcucuguuucacauaaaccagcgucgcggcuucaaguccaauagaaaaaccgauaagaaagagacagacucuucggcccugaagaaagcaaucggucagcucagggaggcuaugcaagccucagggugucggacugugggagaaugguuaugcgcgcgacaucagcagggccugagcguccgcgccagauauagggagaaccggauuaccaaggaugacggcaagacaaaaaucgaaaagaguuacgaucuuuauauugaccgcgcaaugaucgaggcugaguuugaugccuugugggcuaaacaguccgaacugaaucccgagcuauuccacgaaaccgccagagcagagcucaaggacugucugcuucaucaaaggccucugaaaccagugaagcccgggcguugcacuuugcucccugacgaagaacgggccccacuggcuuuacccucucagcagcgauuuagaauauaccaggagguuaacaaucugaggcuccuucgcgaaggacugaacgaggaaccuuugacacuaacccaacgggaucagcugauccaggcgcucgagacgaauccaaaaagaucauucacucaaauucagaagcugcuugguuuuuccggccaguucaaccugcaggacgauaagaggaccgaauugaaagggaauagcacaagugcaaugcucagcaagaaagaguuuuucggaucucaauggcuguccuucgacgagacucaccaggaugaaaucgugaugcaguuagucucagaggaaaacgaggcccgccugauugcuuggcuacaggccgaaaccggcguggacgagaucacagcagagcgaauagccaauaccccgcucgcugaagguuaugggagccugagugccaaggcacuugagaaaauuuugcccgcgcugcgggcugauguaaucacguacgacaaggccguucucgcagccggauuugaucaccauucucacauuucccaugcugccacuggcgaaauccugccugaccuuccauauuacggccaauaccugcagcgucacgugggguucggaacagguaagcccgaggauccugcagagaaaagauauggcaagaucgcuaacccaaccguccacauuggguugaaccaggugaggacuguggucaaugcccucauaaaacgcuacggacaucccagcgaaguugugguagagcuggcgcgggacuuaaagcagucgcaagaacagagaaaagaggaacaggcccagcaagcuaagaaccagaggcgaaaugagcgcaugcggcaggacaucgcaggccugcuaaacacaucuaccgagagagugagggcccucgaucugcaaaagaugauucuuugggaagaguuguccuuuaaugucgcugaccgucgcuguccguauucaggugugcagaucagugcccagaugcuguucagcgaucagguugaaauagagcacauucucccuuuuucccaaacgcuggacgauucuuuaaacaauaaaaccguggcaaugcggcaggcgaacagaaucaaggggaauaggacacccgccgaagcugccgcagacuucgcugcccagggcuggccagucgaggauaugcugcaucgagcaagccuuaugccuaaaggaaagcgguaccgcuuugcccaggacggcauggcucaaugguugagagaggauaaaggguuccucgcgagggcccugaacgacacucggcaccuaucacgaguggcaagagaauaucugagucucguaugcccccagggaacccgcguuaucccagguaggaugacagcuaugcugcgugccaaguuuggccuuaaugauauuuuggggcugaacggagagaagaaucggaacgaccauagacaccacgccguggaugcuugugucaucgcagugacugaccaguccauguuacagaaauucgccaaggcgagcgcuucugccagggaaaaacaacucaauaagcuggucgagucaaugccccuuccuugggacaguuaccgcgaucaugugcagcgagcaguugaaagaauuugggugagccacaaaccagaccauggccacgagggugccaugcacaacgauaccgcuuaugggcuguugggcggaggccauguacagguccggaagaggauggacggggugcgcacacgugagaccgcagcccucaaaguuauagaauuugcggauagacaagcucacccgcggcauggacugcuacccaacggugagccuaugccauacaagggcuacaagggggacuccaauuauugcauggaaaucgugaggaacgauaaaggaaagugggagggcgaggucgugucuacuuucgaagccuaccagcugguacgccagcacggucucgcacgacugagacaucccgcccuuucggugagcgggcggccuuugguuaugaggcuguuacgcaaugacacgcucagagucauucacaacggcgagcagaggacagugcggaucuguaaaaugaccgcugaaggagugaucgcccuggcagauacuaccgaguccaaugucgacgcucguacacgcaccaaggaucuuucauauauuuuuaaaacugccggcagucugcaaaagucuaaggggcgaagaguugcgauaagcccauccggagaaaugaaagaccccggcuucuucgauuga

SEQ ID NO: 2593 - RNA, 3051 nt, Artificial Sequence
  Cas9 variant
auggagguguucgucgacguuagcgccagacagcugggcaucgaucucgggauuggaaccugcgguugggcacuucuggcugaagacuccuugauagccuuaggcacaaggacuuuugaugugcccgagacggacaaggaacggaucccuaccaaccaaauucgccgacaggcgcgugggaugagaaggguaaucgaucggcgcagacagaggaugaaugcugugcggcgccugcuagccgaccacggacuccuggcagauggcgguaaacuugggcuggccacaguccgauuggacccauggcaggcuagagcagagggacucgauaggcugcugucugccggcgaacucgcuguggccuuaggccauauugcgaagcaccggggguuccguucaaacaguaaacgcgacagaggagcaaaugccccgaaggagagcuccgcuaugcugggugccaucgcacaaacuggcgagaggcuucagcauuggcggaccguuggggaaauguuuuggaaagaugaguucuaccagacacgacgcagaaacagggacggagauuauucucggaccgugcagcgcuuggaccuggaaacugagguccacagacuacucgcugcccaaaggcgucugggcaauccccuugcgacauuugaccuggagcagucguucauagauguggccuuuuuccagcggccuuuggcagacucagaugacaagguagguccaugucccuuugaaccuagcgagaagcgagcugccagacauaguccauccuucgaaagguuucgccuccugucucgguuagcugcccugagacucagcuccggggcaggagagaggccccuuucagaugccgaguucgcugcggcaugcgccgacuuuggccgccugcagggcuucaguuucaaacgauugcggcaacaccuaaagcuggauccuagcauccguuuugcugggauugccccagacgaggagggaaaaagagauguuguggcaaggucuggugaagccaccccgggcuccgcugcccuccgccacugucugggggacacggucugggauaacaugcuuggaacucggcccgcacuguuggacgcgaucgcugccauucucaccuucagagacgaugcagacaggaucgccgagggccuggcugguuuagggauagaggaaccuauucuggaugcccuaauggacggcgugcgaaauggaucauuuggcaaguucaaagggccaggacauaucagcgcaaaggcuugccgcgcccuccugccccaccuugcgcgggguagaguguacagugaugccugugcugacgcaggcuaugaucauucuaggcagacagaaacuaacuuggacgauauucguaauccugucgcccgcaaggcucugggggaggcccucaaacagaucaagaucauuauacacacccacggacggccaacagcaauccauguugagauggcgagagacauuggcaaauccgccgaugaaagggacgagaucaagaaagguauagauaagcgaaacagcgaaaaagaccgggcucgccaacaguuucacgagaugguggggacccccgccgcaggcgcugaagaccugcuuagauucgagcuguggaaggagcagaauggauggugcuuguacacgggcagggaaauuccgaucgaugcccucguaucgucugacaaccggauccagguggaucauauucugccuuggucccgaucaggggacgauaguuauaucaauaagacuuuauguuuuacagaggcaaaccaacacaaaaagggaaugacccccugggaauggcugcaugacgauccagagagaugggagaaauucgcccgcacugucgaagguugcaagacaaugaaaggcaggaagaagcguaaucuacuccugcgggacagcuccagacuugagaaagaauuuaggucucgcaacuugaacgauacccgauacgcuuguagacugcuccuggggauuuuaaagcacacguauccugacauagugguugcggcccggcccggaccacugaccgauaggcuucgccgugcauggggcuugcagagccucaaaaagcacgaggacgguacaagaaaagaugacgaccggcaucacgcucuggaugccgccguggucgcugcaacuucacagaguaugcuacagaggcugaccacacucuuccaaaaggccgaacgcgaagggggccgaagagacuuugugggacuggagcccccuuggccaggcuuccgggcggaucuugaagcuaaguuggaggggguaguuguguccagggccgaacgcagaagggcacggggagccggccauaaagacacuauccgugcuauuggugagggggaugcaggaccggucguguacgaacgcaagcccgucgccgcgcugaccgagaaagacuuagaucgagugaaggacccugagagaaauaaaguucucaucgaaaaccugaggcaguggaucgcugccggcaagccaaaggaucccgacaaagcaccucggagcccaaagggugaucccaugacaaaagugaaacuuguaaccacugacgacguccgcauucuggugagaggcgggacggccgauaggggagacauggcucggguugauguguuucgacaggccgacccgaagggcagauggcgcuucuucuuggucccuguguacccacaccagguauuugaucccacagacuggccucaacccccaaauagggcagugguugcuuauaagccugagaaagaauggaccgucauggggcccgaucacgaguuccucuggucucuguacccauuuucauggauagccguggaaaaggcggacggaacucggaucgagggcuauuuccgugguaugcauagaaguaccggggccauuagcaucuccccgcaccauucuaagucgcuagcaagcacaggaauuggcgcuaaaacccuggccuccuuuaggaaguucgcuauggaucgcauggguaaccucucagagaucgaacgggaggugcgaacuuggcacggcgucgcaugcacauga

SEQ ID NO: 2594 - RNA, 3054 nt, Artificial Sequence
  Cas9 variant
augagaguggacagccuggggaggugccucuccgaugaggaaugggcccgggucaucuaccaccuuuguaagcaucgcggcuuccacuggauuucucgagcugaggcaaaacagaccgaaggagacucaaagagugaggguggcaaaguuaagcaagggcuggccggaacagcgaaauugauggaugaaaagggcuaucguagcgcugccgagaugguguuagcagaguuucccgaagcccagagaaacaagcagggugaguacaggaaagcucugucccgggaacuacucgcaaaggagcuggcccuucuguucgcucgccagagaguauuugggaauaggcaugccacugacacguuggagaccgcgauacucggaaacucugauaaaaagucgggccuguucuggcaacagaaaccugcacuggccggcgcugaccucuuaaagaugcuggggacaugcacuuuugaaaagaaugaguaucgggccccaaaagcaucauucaccgcugaacgccacguguggcuuacacgauugaacaaucugagaaucgucaccgauggaauuacuaggcagcuaacagagcaggaacggcaacucgugcugccgcuucccuaccgucaggccggugaccugaccuauaagcaguugggcauggcgcucacgaaagccgggcuguuagaggcaggauguuuuaaguucaucggccuggcuuacccuacugaggcccagaaagcugaagguaagaccaaagauccagagagcgccacacucguuaagauucccgcauggcaagaacuucgccagacucugaacaaggccaguuugaaugacgagugggaaaaacuauccggggaugcucugugcggacagccugagaucuuugacaagauagcguggauccucucuguguauaaagaugacgacgaggucagaaccgaacuggcaaaacuugugcugccaaaccccgagggcuugacagaagcccuccugaauauuagguucgauaaguuucaugcuuuaagccugaaggcccuacgggcaaucguaccucacauggagaagggccuccgauacgacgaagccuguguucaagcuggguaccaccauucccagcugcacaaaauuggagagggugagcauaaguaucuuccaccguuguacgauggccgcgacggggauggaagaaugaucuucgccgaagacgcagauauacccaggaacccugugguccugcggucacucaaucaggcgcgcaaaguggugaacgcuauuaucagaagguauggcaguccaagcgccguccacauugagauggcacgugaccugucucggcccuuugaugaacgaaauaagaucaaaaaggaccaggaugaguaccaagccagaaaccagagggaccgcgagcaguucaucgaacuuuucggucacccuccaaaggggcuggaguuugaaaaauggcgguuguauagagagcagaauggccaaugcgcuuacucccagaagccccucgccucaagcggagacguugcagaaauuuuccuggauggcaguaccgagauagaccaugcuuuaccguauucuagguccuuugaugacagcaaaaacaacaaggugcugguacuaacgcgcgagaaucgagauaaagggaaccggacuccuuacgaauaccucggaggugccgagaauagugaacguuggcagagauucuuuucuuucguggaguccaacaaggcguauaggcuggccaagcgcacacggcuuuugagaaaagacuuuggcgcuaaggaaucagaggaguucagggaacgaaaucugaacgauacccgcuacgucugucgguuuuucaaaaauuauguggagcagcaccucaagcuggcagaagggagugaggccaaaagaugcguuguggucagcggacaauuaacuaacuuucugaggacacguuggggccuuuugaagauccgcuccgacucugaucggcaucacgcucucgacgccgcagugguagcggccuguagccauucaaugguucagagacugaguaauuacuccaggacccgagaacuagaacaggugcgggaugguuucgucaacauugagacgggggagaucgugaaucccgcuaugcaccagcaacugcgcgagcacuuuccagacccuuggcccuauuucagacaugaacucgaggccaggcugaaaauagauagcccagcacuuuugcgggaggaaauggcucgacugucuucauacaccgaggaagaguuagccgcacucaagccccuguucgucaguagagccccucagcgcaggaacggcggagcugcgcacaaggacacaauuuauggccagccagaaaaacuuaagaaaaaugggagcgugucccaaaagguugcccuggcaucuuuggcucucaaagacaucgaucugcuagccgacccgcaucguaacgccaagcuguacggagcuauccgggagagacucgaggcacacgguggcaagggggauaaagccuuucccgcgacuaauccucugaggaagccagacaaagaaggaaaccccaccggcccuauugugcgcacaguaacuaaggucaucgauaaacuuucggguauuccagugcgagggggcauagcuaagaacgacaccauguugagaguugauguguucacaaaggccggacgguuucaccugguccccguguacguacaucacagggugaccggcuuaccgaaucaggcaaucacucgcgggaaagacgagaaccagugggccauuaucgaugacacguucgaauggcguuuuagccucuauccuaaugaucugguucagaucagacuuaaggacgagacacaucugggauacuaugcuuccaccgaucggucaacuucgucuauuagcauaugggcacacgacaggaaccaauccgucggcaaagacggucuaauccgcucaauuggggugaccacagccaaggauaucgaaaaauuccauguggacacccucggaaaugucuacccagcgcccccugagaagcgaagaggccuggcuuga

SEQ ID NO: 2595 - RNA, 3066 nt, Artificial Sequence
  Cas9 variant
augagaaggcggcgcgaccgauucaagcagcgucaagccgcucugcucaaacaccuugcaggcguggggcuguuucccgccgaugaggcggcuagaagggaauuggccggauuagacccuuacgagcugcgggcacgcgcccuacaugaagcucucccacugaaccacaucgguagagcacuuuuccaucugaaucagaggcggggcuuuaagagcaaccgcaaaaccgaucgagggaaggccgacgaugagggaaaaauuagauugggcgucgcuaggcuccaggaagccaugcacgagaaggguuccgcgacacugggggaguuccugcauggacggcgugcagccgcuacugacccgaaucagauacccucuguucgcacgagacucagggccgaaucaggcgagggcgcacgaggggauggauaugacuuuuacccugaucggcgcauguuagaagacgaguucgaggcuaucugggaaagucaacaggugcaccacccagccguacugaccgaugagauuaagcagagauuuuucgaagugaucuuuuaucagaggccccuuaaacaaccugagauugguacaugcacuuuggucgcgggcgaacggcgccugccaaaggcccauccccuauuccagaaaagaaggcuccuggaggagcuuaacgcacugcguaucguguggccugggguucaggcugaauugcucagccgggagcagcgagaccuggccuacuuaaagcugaaagauaagagagcugugagguuugaaucccuccgcaaggcccuuaaacuggacccagacgcacgguucaauaaggagucugaaaacagaucggaguugaaaggagaugaggucgccgcugaacuaggcgcgaagucaagguuuggugggcgcuggggacacaccgcaccggccgaccaaugggagauagugagccgaauccaggcucuggaaagugaugacgaugaggcccaguucuguguauggcucuccgaacgguauggccuggacucugagcaagcacgugccguugcugccgcaagacuuccccagggcuucgggagguuuggacugacagcgaccacucgcuugauuaaagcucuccaggaugaggugaucgucuacagcgaagccgugcagaagacaggucugggccaucacuccgacuuccggaauggggagguguuagcagaacugccuuauuacggaauugcccuagagagacacaucaugccaggcaccggugaucccggggacucagaugagaugagggucggccgaguuacgaacccuacugugcauauaggacucaaucaacugcgccggguagugaacagacuuauuaaaagguacggcccaccccgucagaucgcugucgaauuggcccgcgagcugaagcucgacgaccagcacaagcgggaaauuaaugggagaaacaggcagaaucgagaggcagcugaacggcgcagucaaaaacugguggauaucggaaucgccgacaagggugcgaacagagcccuucugaaauugugggaggagcucaauccggauaacgcucuggacaggcggugcguuuauaccggccgacagauuagcauagaaauguuauuuucuggggcaguggaggucgaucauauccugccuuucgccgcuacacuagacgauuccaacgccaauaagcuccugugucuuagagaagcaaaccgcaauaaaaggcgucggucacccuuugaggcguucggacagggcgccgacugggaagagauugcugccagagcagcuagguugccacgcgagaagcgauggagauuugaaccugaugccauggcacgguucgacacugaggaaaaguuucuggccaggcagcucguggauacccaauaccugagccgcuuagcucgugaguaucuggguguacuuuuccccgacaaaggggaaggcaguggaagaguuugggugucuccaggccgguugacagagaugcucaggcgcuccugggggcugaaccaccuacugcccgaucauaaucucggagguggcgcggaccagccuaagaaccgaagagaccaccggcaccaugccaucgaugcaauagucguggcugucaccgacaggcaucugcuucaggccauugcccgcgaggcugggcagagaggacacgaagcagccaauaggaugacggcggauuugccagugccguggcccgacuuugaucgggacguuggccaagugauccgucagguagucgugagccaccgcgcugaucacgguacuguuucgaaagccggggcagccaagggccaggacucuacagcuggacgacugcauaacgauaccgcauacggcuuaacugggcaaacagacgagaaaggaaauaccaucguggucagaagggugccucucacggcccugaagaagccaaccuccauugaagcgguacgggaugacgagcuucgcaaagcucugucaguguggacaagaggcuaugaugguaaggccuucgaggcaagguugagucgguuucccgaacucgggccucugcaguuccgaggaaucagacgcguuagggucguggagccacuaacugugauucccauacgggacagcuccggccgugucuacaaagguuauaagggcgacucuaacuacagauacgauguuugggaacugaaagacgggaaguggguggccgaggugguaagcauguucgaugcucaccagucaaguuggaccuccccggucaggcgcgaaaauccuacagcccggaaggugcucagccugcagcaaaacgacaucguugcaauugagccagagggaaaagaacgagagcuuaugagaguggcucaguugaggcagggcgggcagaucacucuggccgcgugccaugaagccggagauuuaaagcgccgggacgcagagucuaaugaagucgaucccuuuaaauauuucucaccuaccgcuggcggucucaagagagugcgugccaggcaaguucggguggacgagcuggggcgcguacuugaucccggaagucgagacagagagaggggcgcugcauga

SEQ ID NO: 2596 - RNA, 3066 nt, Artificial Sequence
  Cas9 variant
augaaguacacccugggccucgacguggggaucgccagcgucggaugggcuguuauugauaaagacaacaauaagauaaucgaucuuggugugagaugcuucgacaaagcagaggaauccaagacaggcgagucucuggccacugcgaggcggauugcucgcgggaugcgacguagaaucucaaggcggagucagcgcuugagauuagugaaaaagcuguuuguacaauaugaaauuaucaaggauagcuccgaguucaacaggauauuugacacgucucgggauggauggaaagaccccugggaacuacgcuacaaugcccucucgcgaauccugaagccuuaugagcuuguccaggugcugacccacauuacaaaaagaaggggcuucaagucaaaccggaaagaggauuugagcacuaccaaggaagguguugugaucacaaguauuaagaauaacuccgagaugcuccguaccaaaaauuaccgcacuaucggggaaaugauauuuauggagacaccagagaacucuaauaagagaaacaaagucgacgaauauauucauaccaucgcaagggaggaucugcugaaugaaauuaaguacaucuucagcauccagcggaaacucggauccccguuugugacggagaaguuagaacacgacuuccugaacauuugggaguuucagcgacccuucgccucaggcgauaguauacuuagcaaaguaggcaaguguacuuugcugaaggaggaacuacgcgcuccuaccucuugcuauacauccgaguacuuugggcuccugcaaucaaucaauaaccuuguucugguggaagacaauaacacuuugacccucaacaaugaccagagagcaaaaauuaucgaguacgcccauuucaagaacgaaauaaaauauagcgagauuaggaagcuguuagauaucgagccagaaauccuguuuaaagcucacaaucucacacauaagaaccccaguggaaauaacgagucuaagaaauucuacgaaaugaaguccuaucacaaacuuaagagcacccugccuacggacauuugggguaaauugcacucgaauaaggagucucuagauaaccuguucuacugucucacugucuauaagaaugacaacgaaaucaaagauuaccugcaggccaauaaccuugacuaucugauugaguacauagcgaaguugccaacauuuaauaaauucaagcaucucucccugguggcaaugaaacggaucauucccuuuauggagaagggcuacaaguauucagaugccugcaacauggcugaauuagacuucaccgggaguagcaaacuggagaaguguaauaaacuaacuguggaaccuaucaucgagaacgucacaaacccaguugugauucgcgcccucacccaggcaagaaagguaauaaaugcuaucauucaaaaauacggacugccguauauggugaacaucgagcuugccagggaagcgggcaugacgcgucaggaucgggacaauuugaagaaagagcacgaaaacaaucgaaaggccagagagaagauuuccgaucugaucaggcagaacggucgcgucgcaucugggcucgacauacugaaauggcggcuuugggaagaccagggaggcagaugcgcuuacagcggcaagcccaucccugugugugaucuguugaaugacucacucacccaaauugaucauaucuauccauacaguagguccauggacgauagcuauaugaacaaaguucugguguuaacagacgagaaucagaacaagcgcucuuacacucccuacgaggucugggggucaaccgaaaaaugggaggauuuugaagcccgaauuuauaguaugcaucugccucagagcaaggagaagcggcuacucaaucguaacuucaucacaaaagaccuggauuccuuuauaucuagaaaucuuaacgacacuagguacauuucgcgcuucuugaagaauuauaucgaaagcuaccugcaauuuuccaacgauucaccaaaaaguugcgugguauguguuaacggacagugcaccgcucagcuccggucuagauggggucugaauaagaacagggaggagagcgacuuacaccacgcccuggaugcagccgugauugcuugugcggaccgaaaaaucauaaaggaaaucacaaauuauuacaacgagcgcgaaaaucacaacuauaaggucaaauacccccuuccguggcauuccuuccggcaggacuugauggagacccucgcaggcguguuuauuucaagagccccuaggcguaagaucacugggcccgcucacgaugaaacgauucgcagcccaaaacauuucaauaagggacugacaucugucaaaaucccucuaaccacugugacccuggagaagcucgagacaaugguuaagaacaccaaaggcgguauauccgacaaggccguguacaauguacugaaaaaccggcuuauugaacacaauaacaagcccuugaaagcauuugccgagaagaucuauaaaccacugaagaaugggacuaacggcgcuaucauuagaaguaucagggucgaaacacccagcuacacgggaguguuccgaaaugagggcaaggggauuucugauaacuccuuaaugguucggguggacgucuucaaaaagaaagauaaguauuaccucgugccuauauauguagcccacaugaucaaaaaggagcugccaucaaaggcaauugugccgcuuaaacccgaaagucaaugggagcugaucgacagcacccaugaauuuuuguucucgcucuaccagaacgauuaucugguuauuaagacuaaaaagggaaucacagaggguuacuaccgcuccugccacagaggcaccgggucucuaagccugaugccucauuuugcgaauaacaaaaaugucaagauagacaucggagugaggacagcuauuucaaucgaaaaguauaacguggauauucucggcaauaaaaguaucgucaagggugagccacggcgagggauggagaaauacaacuccuucaagucuaauuga

SEQ ID NO: 2597 - RNA, 3072 nt, Artificial Sequence
  Cas9 variant
augaagauccugggcuucgacauugggguggccagcauaggaugggcuuuugucgagggugaugaaaucagagacugcggcguuagaauuuucaccaaagcagagaaccccaagacaggggaaucccucgcccuuccucggcgcgaggcgcgaggagugcguagaaggcuggcucggcgcagaguaagguugaauacuaucaaaaagauuaucuguaaagaauuugauuuacggcugucugacuacauagccgaugacggcgagcuaccaaaggcauaucagacgaacaaggauaccaaaucaccguacgagcuccgcuauaaggcccugaaugaacgacuuaguaaagaggaacuggcuagagugaucuugcacauugcaaagcauagggguuacgggaacaaacacgccaaggacggagaugacaaggauagcggcaaagucaagaaagcuaucggcgagaauaagacacuccuggagcaaaaaggguaugaauccgugggagaguacugcuuccgggaauuuuucaagucuauuaaagacaaggauggugagacucauaacauccccucgcagaauauacguaacaagaaaggcaauuaugaccgcuguguuucacagaagcagcuggaagacgagcucaaauuaauuuuugccaagcaaagaaaacugggguucaacaaggaguuugaagaugcgauccuugagguggcauucuaccagaggccuuugaaggacuuugaugacaaaauuggagauugcaucuucuuugacaaugaaaagcgggccccaaaagagagcaucagugcuauugaauuugucgcccugacccgaauaaucaacacacuaaaguaccucuccaaaaccacuggcgagguguaugagaaggaaauuaucaauaagauauggcagaaaauucuggagaacgguaagaugacauacgcagaacuucgcaaaauccuggcuuuggauucuagcguauucuuuaaggacaaagaucucgacuauacccuggggaucaaggaggccgaaaagauuaaauucaucgaguuuaagaaauuaauuaaguucaaaaaggcgcugggauccuuugauggccucucaagagagauacuugacaauaucgccaugcagauugcaaucacgaaagacaggcaacggcuguuggaaaagcuagagguuuucccccugaacaaggaacagaaagagaaccucagucagcugaauuuuagcaaguacaucgaucuuucucugaaggcuuugaaccagauucucccuuucaugcgcgagggcagaagguaugacgaagccaaggaugacgcuaaacugcaagagaaggccaagaauacuaaaaaggaagaguuuuuaccaccccugaaagaguucgaucuaaaccucaccaauccuguggucgcacgugcccuggcugaauuucggaaggugcuuaacgcguugcugaaaaaguacgggaaggugcacaaaauacaucucgaguucgcacgagacaugagacuggauuuugacgaaagggagcgccuuaucuccauucagaaugauaacuucaauaagcggcagcuggccgaagacuucuguaaagagcacggauuggaaccaucaaacgcuaauauccucaagauuaaacuguggcaagagcagcaguggcacugcauguauagcggugaguuaaucggcauaccggaucugaaggaccccacaaagcuacaggucgaucauaucuacccuuacaguagaucuuuugacgacuccuauacuaacaaaguucucgugagggccgaauggaaucaagagaaggggaaccacaccccauucgaagcauuuggaggcgauaaaaauaagugggacaaaauuguagcccuggcugagaaacuucccccuagcaaaaaguugaaccgcucggaaaagucuaaaaaggauaaacugcucgacgagaaguucaacgauaaagagcuggguuucuuagcccgaaauaucguggacacaggguacauugcacggcuggucgcgaaguauaucgauauguaccuugaguucuugccacucgaagaaaacgagaauaccucccuggcucguggcgagaagggaaguaaaaagcauauaggcauugugaacgggagacuaacgucagaaguuaggcacaauuggggacuggaccccaaagaucgcgacaaccaccuccaucacgccaucgaugcaauugugaucgccuauaugaaugacaagcggauaaaggcuuuugccgauuucagaaggcugaaagagcuuaagaucaaacgauacggucgcgaaauuacugaggacgaauaucaggagaagaaaaaggaguugagcugugcaccguuugacgauuuccggaacagaacacuggaaaauaucgacaaaauuuuugucuccaggccuccccguaagcgcgcucggggcaccuuacaugaggaaacuuucuacucuaucgaugacaagaaacuccugaaggccuacgggggaaaagagggcaugcagagagcgcuuagccuggguaagauaaggcagauugggacaaaaaucgugaagaacggcaccaugguacgaguugauaucuuuaaggacaaacggggacgcuucuauggcgugccaauuuacacgauggauuucgccuuggggguccucccuaauaaggcugcagugucaggaaaagacaagaacggucugaucaaagaaugggccgagauggauaguggcuaugaguuuugcuucucccuauuuaaggacgaucugauucucguccaaagaaaagaaaugcaggagcccgaacuguguuacuucgugagcuuugacucuucaaaugcucagauagacguuaggagucacaacaaucauuucagcgugcuuaacgagaaccagaaguugcuguuuaaguccgccacccaagcagaaguaaucggggagucuauuggaauccagaauuuaaaagucuucgagaaguggcacgugucgccacucggcgaaguucggaaagcggaguuuagcccccgaggugaagccaagcugaaaacauccaagaagaggaaaaaguga

SEQ ID NO: 2598 - RNA, 3072 nt, Artificial Sequence
  Cas9 variant
augaagaucuacagcuucgacauuggcguggccuccauagggugggcuuuuaucgagaacgaaguccugcaggauugcggaauuagaaucuucaccaaagcagagaaucccaagaacggugccucucucgcgcuuccuaggcgggaagcucgcggcguucgaaaacgucuggccagaaggcgggggcgcuugaauacaauuaagcaauuacuguguaaagaguuuggacuacagcucgaagacuaucugucaaacgauggcgagcuuccaaaggcauacacugccaguaaggcuaauccgcugaaaagccccuaugaguugagaacgcucgcacugucccagaagcuggacucuaaagaucucgugaggguaaucuuacacauagccaagcaucgggguuacgggaacaaacacgcuaaggacucgaaggauaccgaaucaggaaaagugaagaaagccaucgaguucaaucgcaagacacuggcggaaaaaggcuaucgaagcgucggcgaguaccuuuauagagaguuuuuccagcaaaguaggauuucccagaacaauggggcaacugaauuuaucaacgugcggaauaaggccggaaacuacgagcauugcguugcucaggacauguugaaagaagaacuggaaucuauucuaaaugcccagcgucaauucgguuuuagccucaagcaggauuucgaguccaagcugcuuaccaaaaucuuugagcagcgcccucugaagucauucgcagacaaagugggcaacuguugcuuuauagcuggggaaaagagagccccaaaagauagucccagcgcgauugaguucaucgccuugucuaggacaauuaauacccucaucaaccuguccaaggaaucaggagagaucuacaaccgggcaauuauauuacagaucgucgaaagcacucugaagaaaggcgagauuaguuauaaggagcuccgagaaaucauacgccuugacgagagacugagguucaaagauccucgguuggacuacucucgcgaaauuaaggaggcugaaaaagugaaguuucuagaguucaagcaacugaaagguuuuaagaaagcccucggggaguccuucacaacccuggcuaucagccagcuugacgaaaucgccgagcacauugcacugaucaaggauagaguaaaauugaaugaaaagcucgagucguaugcccugacgaaggagcagagggaggcuuuaucuaaccuguccuuuucagcgcauauuaaucuaagucuccaagcacugaaacagauacuuccauucaugcguggagacaacggcgagcaguguuuggauuacgacgaaagcguugagaaggccggccugaaagcucucuccaaggauacucugaaagggcagaugcuucccccucugaaugaauuugagccauauuugucuaacccgguggucgcccgggcacucgccgaguaccgaaaggugcugaauguguuacugaaacaauauggaagcccccacaagauccacauugaauacgcuagagaggccaagcuaucaaguaccgaaaggcagaaauacgagaaggaacagaaagacaacuaugcagcgaaucaggcugcccauaagaaaugccaagagcucggucuggagccuuccagcacaaaccuuuugaagcugaagcucuggcaggaacagggcgggcuguguuuauacucuggagcaaaaaucacuaucucauaucugcaggauccaaccgcccuucaagucgaccacauuuaccccuauagucgcagcuucgaugacuccuacaugaauaagugcuugguucucacaaaagcuaaccaggagaagggcaaucggaccccuuuugaagccuucgguacggauucugcaaaauggggcgugauaacuacacuggcucagaagcuaccacauaagaaaagaaggcgcauccugaacaccgccuuuaaugacaaggaggcgggguucaaacuccgaaaccugaacgacacuucguauauugcccggcuuguagcugauuacacagaaaccuacuuggaguuucugcccuuaguggagagcgaaaauacgacccucuccaagggacagaaaggcucaaagaagcacaucgcaauugucaacggggugcugacaaguacuaugcguuauuaccuuggauucgccucuaaagacagagauaaucaucugcaccacgcuuuggacgccguuaucauagguuucaugaacgauagcgugaucaaggcauuuuccgacuucaaaaagacccaagagacaucaaaagcggccuauuacgcucauacucucagcaagcaggaauauaaaaagcagagggccuuuauucaacugccgucuggcgagaauuuccgcgucuccgugcuagagaagguagaaaguguuuuugugagcaaaccuccccggaagagaguccgaggggcacugcacgaggcuaccuucuacucuccaaacgauccuaaacuccugaagaauuauggaggcacaaaagguguggaaagggcccuugcauuggggaagaugcgcaaggucggcgccaaaaucguguccaacggagcuaugguucggguggacauuuuuagacauaagucaaguggcaaauucuacgggguacccgucuacaccauggauuuugcgcugggaaucuuaccaaauaaggccgugguuguggguaaagaccagaacggcgucauaaaggauuggcucgagauggacagcucguaugaauuuauuuucucccuguacaaggaugacgugauccuuguacagaaaaaggagaugcagaggcccgagcuguguuauuucgugucuuuugacacuagcggggcaucaauuaaaguugcuaagcacgauaauaacuucaguacgcuaacagaaaaucaaaaacuccuguucuccaacgccaccaaggaggaagucgugggaaagucuaucggcauacagaauuugaaaguguuugagaaguggcaggucagcguucugggugaagugaaacguacucaguccuacccucgcgagaacaucucauuagccagcaaggcuaaaaaguga

SEQ ID NO: 2599 - RNA, 3075 nt, Artificial Sequence
  Cas9 variant
augaucagaacccugggcauugacauagggaucgccagcauuggaugggcugugaucgagggugaauacacagauaagggccucgagaacaaagaaauugucgcauccgggguuaggguguucacuaaggccgagaaucccaaaaacaaggaaucucuugcgcugccucggacguuggcucgcucagcccgacguagaaaugcaaggaaaaagggacggauccagcaaguaaagcacuauuuaaguaaagcccugggccuagaccucgagugcuuugugcagggugagaagcuggcuacccuuuuccagacaagcaaagauuuucuguccccaugggaauugcgcgagagagcacucuacaggguccuggacaaggaggagcuggcccgggugauacuccauaucgcuaaacgccgaggguaugaugacauuacuuacggaguugaggauaacgacucuggcaagaucaagaaagccauugcggaaaauucgaagagaaucaaagaggaacaguguaagaccauaggcgagaugauguauaaauuauacuuccaaaagucacugaacgugaggaauaaaaaggaaagcuauaaccggugcgucgggcguagugagcuucgcgaggaauugaagacaauuuuucagauccagcaggagcugaaauccccgugggugaaugaggaacuaauuuacaagcuccugggaaaccccgaugcacaaucuaaacaggaaagagagggucuuaucuucuaccagaggccucugaagggcuuuggggacaaaaucggaaaguguagccacauuaagaaaggcgaaaauuccccauaucgggccugcaagcaugcucccucagccgaagaguucguagcauugaccaaaaguauaaacuuucucaagaaucugacuaaccgacacgguuuauguuucagccaggaagauaugugcguuuaccuggggaaaauccuccaagaggcucagaagaaugaaaagggacuuacauauucuaaacugaaguugcuacuggaccucccuuccgauuuugaguuccugggccuugacuacucaggcaaaaacccagagaaggccguguuucugagcuugcccaguaccuucaaacucaacaagauuacgcaggaccgcaagacucaagauaaaaucgcgaauauacugggggccaacaaggacugggaagcaauuuuaaaagagcuggaaucucuacagcucuccaaggagcagauccagaccaucaaagaugcuaagcugaauuucagcaaacauauuaaccuuucguuggaggcccuguaucaccuccugccucuuaugagagaaggaaagagguacgacgagggugucgaaauccugcaagagcggggcauuuuuaguaagccacagccgaaaaaucgccaguugcugcccccucucuccgaauuagcuaaggaggagucauauuucgauauaccaaaccccgugcugagaagggcccuaagugaauuucguaaaguggucaaugcacuccuggagaaguacgggggauuccacuacuuucauaucgaacuuacacgggacguuuguaaagccaagagcgcucgaaugcaguuggagaagauuaacaaaaagaauaaauccgaaaacgaugcggcaucucaacugcucgaggugcugggcuuaccuaauacuuauaacaauagacugaagugcaaacuuuggaagcagcaggaggaauacuguuuguauagcggugagaagaucaccaucgaccaccucaaagaucagagggcccugcaaauugaccaugcuuucccacuaucacgcagucuggaugacucccagagcaacaagguacucugccugacaucuucaaaucaggaaaaaucuaacaagacccccuacgaguggcuugggagcgacgagaaaaagugggauauguaugugggccgggucuacuccucuaacuuuucgccgagcaagaaaagaaaguugacgcagaaaaauuucaaggaaaggaacgaggaagacuuucuggcccgcaauuuaguggauacuggauauauaggccgaguuacaaaagaguacaucaagcacucccucucauuccugccucuucccgacgggaaaaaggaacacauucggaucauuaguggaucuaugaccagcacuaugcguuccuuuuggggugugcaagagaagaacagagaucaucaucugcaccacgcacaggacgccaucauaaucgcuuguauugagccaucaaugauccagaaauacacaaccuauuugaaggauaaagaaacgcauaggcucaagagccaccaaaaagcccagauucugcgcgagggcgaccacaagcuaucucugcgguggccuauguccaauuucaaggauaaaauccaggaaaguauacagaacauuauccccagccaucacgucucucauaaggugaccggggagcuccaccaagaaacaguaagaacuaaagaguuuuacuaucaggcauucggaggcgaggaagguguuaagaaagcgcugaaguucgggaagauuagggagaucaaucagggcauaguggacaacggagcuaugguccgaguggauaucuuuaaauccaaggacaaaggcaaguucuacgccgucccaauuuauaccuacgauuuugcaaucgggaaacuucccaauaaggccauugugcagggaaagaaaaacgguaucauaaaggacugguuggaaauggacgagaauuaugaguucugcuuuucacuguucaaaaacgauugcauuaagauccaaacaaaagaaaugcaggaggcuguuuuagccaucuacaagaguacuaauagcgcaaaggcuaccauugaacucgagcaccugucgaaauacgcccuuaagaacgaagacgaggaaaagauguuuacagauaccgacaaagagaaaaauaagacuaugacgcgcgaguccuguggcauccaggggcugaaaguguuccagaagguaaagcuaucuguccucggagaagugcuggagcauaaaccucggaacagacaaaacauugcguugaagacaaccccaaaacacguuuga

SEQ ID NO: 2600 - RNA, 3078 nt, Artificial Sequence
  Cas9 variant
augggcggguacaugccccagcugaugagauauaggcucgcccuugacaucggaagcaccuccauugguugggcuaugauacggcugucuaugcaaaacgagccuaucgcaauuauccgcaugggcgugcgaauuuucucagaugggcguaauccaaaggacggaaguagcuuggccgucacaagaaggguugcgcggcagaugcgcagaaggcgggaucgcuuacugaaacgaaagacuagacuacucaacgcucuggugcagaaaaaguuuuucccggaagacgccgaugcaaggaaagcccuuguagugcugaaucccuacgaguugcggaaggaaggccucuaucgucagcuguccgguccugaguuugggcgcgcucuguuccacaucucucaaagaaggggauuucucucgaaccggaagacggacaaaaaggauaaugacucaagcgucuuaaagaaggcaauaguggaucugcgacagcagcuugaaguugagaacugccagaccaucggcgagugguuguucaaacaacagcagaguggcaaguccgugcgcgccagacugagggggaagacacagaaagacaaggcuuacgauuuuuauauugaccgggccaugaucgcgcaugaguucgauacucuaugggucucucaagcaaaauacgacccacuccuguuuaaugaagacgcccgcgcuauucuuagagauauccuguuguaucagaggccccucaagccugugaaaccaggacguuguacccugauacccgacgaaagccgggccccuuuagcacugccacucacacagcaagcucgaauuuaccaggagcuuaaccaccugagaaucaccacuccggccuugggugcgcaggcccuaacaguagcacagaggaauaccauugcugcccugcucgagaaguccgauguuacguucgugaaaaucgcuaaggcccugggccuuacuucaaccacagaauuuaaccugcaagacaucaagcgcgaucgguugaaagggaaugcaacugccauuauacucgcuagaaaccaguacuucggaaggcgcuggcaugacuuuaaugcggaucugcagaacuuaaucgucgacaagcuggugaaugagggcagugaaaccgcacuaauugaguggcucaaagccaacacagauguggacgaaagcgcugccgagcgagucucugguguuacccugcccgagggguauggaucccuuucaguggcagccuugcggcgucugcucccugcucugaaggaagauguaguggucuacagcgaggccgugaaaagagcaggcuucgacagucacucugcgcuuucccugaucgaacagacgggcgaguuguaucaagaacucccauacuauggggagguucugcagaggcaugugggauucgguagcggcgaccccaacgauucgccugagcgccgguuugggaagauagcuaauccaacuguccacauuggauuaaacgaacugagaaagaucaucaaugcccuaauuaaaagguacggcaaccccgcagaggugguaguugaacucgcccgagaccugaaacuuucucgcgagaaacggaaggaaauccaggaggagcagaaacaaagacaggauaggaaugaaaagcguauuaaggacgcuugcgagauauuggguaucgauccgcuggugauugaccgcgggaaacggagagaaaucucccagaagaugcagcucugggaugagcugaacccuaaagacgccgcaaauaggcgaugucccuauacaggcgaucaaaucucaauugagaaguuacugagugcugaagucgagauagaacacauccuuccauucagcaaaaccuuggacgauucccucaacaauaagacuguggccaugcggcgcgcgaacagagacaagggaaauaggacaccuuacgaggccuuuggcgaaucucugaaccccgauuacgacuaugacgcuauucuacagcgggcaagccugaugccacgagagaaaagaaagcgcuucgccucagauggguaccagcaauggcucagggacgauaaagacuuucugagucgugcucuuaaugauaccgccuauuugucccggaucgcaaaggaguaccugacguuaauuugucccccuaacagcgucagagcgaucccaggaaggaugaccgcccagcuccgcgcuauguucggucugaaucgacuucugucugaaggcgggaucaaaaacagagaggaccaucggcaccaugccauagaugcagcugugauuggaguuacagaccagggcuugcuccagaaguuuucaagggccagugcacgcacucgugaacugcaacuaagcagacugguggaugacaugccgcuccccugggauaccuaucgggagcacguaacaagggcccuggaacaccuugucgugucccauaaaccugaccacgguuaccaggggaagaugcaugaggauacugcuuggggcuugcgcgacaacggacagguuacccgaagagugcggucugaggacggcgggccaaggcagcgccuguuagaaaauaagaacgucgugaaaaucaauucgacaagagauuucagcaggcacggaauugacgagcaaggucagguaaacgcguauaagggcuacguugggggauccaauuacugcaucgaaauauggauugaugagaaaggcaaguggaacucagacguggucaguaccuuucaggccuaucagaucgugcgggaacucggugagaaagcagcuuggcaaaagcugcguaauccccuucugucucuaagcgccaagccucucgugaugcgccugauuaucgaugacgucguuaaaaugcagauagccgggcagaacaagaucaugcgaguggugaaaauugcucaaaauggccagaucuucuuugcagagcauaacgaagccaauguagaugcgagagacaaggauaaaaacaauccauucaaguacauuuccaagacugcuggaucauugcagaaagccggcgggauccacauggcaauaagccccauuggagacgccaggccgguccgguauggccgcuga

SEQ ID NO: 2601 - RNA, 3084 nt, Artificial Sequence
  Cas9 variant
augaaguacacccugggccucgacguggggacaaacagcaucggaugggccguccuugagcugaauacuaacggugaaccccagagaauugagaaauugggcuccaggauauucacggaugggcggcacccuaaggacggaaccacauuagcuucuaaacgccgacaaaagcgucaugaaagaaggcggcgcgauagacugcaccagaggaaaaagcuaguucucaaucagcuggugucaaugggccuuuuuccacagagugagcaagaacagcaggaccuuaagagcuuggauguacucacucugcgggcaaacgguguguccaaacagcugucugccuaugagcucgggcgcgucuucuacuauuuaaaucugaagcgaggauuuaaaucgaacagaaagggcggcucagaggaagacaaagcgaauaagaucagcgagaggauuaagaaacuucaagaacaguugaaggagaacgauuucaaaaccguggggcaguaccugcaugaccgguauaucaagggacuaaguacaaaagcuaccauugagaaugauuuucaccuccugcgucagcuuaucgaagacgaguucgauuuuauaguugaaacucaauccaaguucuuuccggagaucucugacgaacaguggaacacacugcgcaauagaauguuccaucagaggcccuugaaaccuguggagaccgguacgugcagccucuuugaggauaagaagcggacuuacaaauauaugccauccuucgaagaguaccgauuucugaccgaauuauucaaccugucauaccaagacgagaauuuccacagucacagccucucuuccgaacagauuuuuaaggucuuccaugagcuuaaaaacacacgcgaggccacuuauaccaagaucaaaaagcuguugaagcuacccucagaccugagcuuuaguauugaaagaucuaaauccaaggauaaaaucaagauaagcacaaccaaucacuucuuuucgaaaucucuccuguucgcagaggaaugggccucccuugaccugaaguugaaggaugagguggcugaaauuuacuuuucagacaugaguguagaggagaucaaaaagggccuccugcaguuaaaaauugauagcgaaaucaucgagaaccugcuagaagagaagguuccuaacgugcaggaggcaacguguuccuauucuaaagaagcccuccaaaagauugucagccugauacuugaggaagagaggcauccaacuuugaucguggacgaucuguucaagaaugaaaaagaggagacaucacucauugaccggcuggauuacuauggggcuaguauccccgacuccaugcagccuauaccacagcacauuaaggauaacaaucuuacccugaacgaagacgagaaacgcuacggaaagaucgccaauccgacugugcacgcggcauugaaccagaucagacaagucguuaaugaccucauugaacaguauggcaaacccacaaacauccauauugaguuugccagggaucugaagaaaagcaaggaggagcgugacuucgauaaucggaagaaaaagaaaaacgaggaauuaaaugaacaggugcgagacuuuauagaaaagcacaaccagaaaccuucugcuuucaauuuugagagaguaaagcugugguucgaacuagaugccaugaacaaucaagugugcgcauacucagguaagaccaucagugcuaggaugguccucagcgacgaggugcagguugaucauauucugccauucucccgcacgcuugacgauucuuuggccaacaaagugcugguccucgcgucggagaacgugaagaaacggaauagaacccccuacgaagccuuugggcaggacacagagaagugggcaagcauccaggaacuggcuaaaagguuaccuuaucacaagcaauggcgcuucgccgaggaugcuaucaagaaauuugaggaaaaggaccaguuccugcagcgacaucuuaacgauacucgguacauuuccaaaauagccaagaaauauuugggaucaaucaccgacccauacaagauuguagcaagucguggccaaaugacaucuaucauuagaggcaagcucgggcugaaucaguuuauccagaaacccgacggaacuaagaacagggaggaucaccgccaccaugccauagacgcucuaaccguugcgcugacaagccgguccuaucucaaaagaaucucagaugcaagcgccaggaaucaggacccgaaccgcauuccuauccccgaaccauggaaggguuucauuaaagaugcugacgugaaguuuaaugagaucauagucucucacaaaguggaucauggcaagaacgggccuuucauggaagagaccuguuuuggacugauuaagaaucccaacaaauacgaggaagagaaugacuucaagcugaucacuacgaaauccuuggauagugucaaggacccaagcacaauucgaucucaaucccugcagaacuuagccgaaaaaucaggcgugaucagucucgcaaagagcgguguuaagaaacugcggguguaugauguaaccaaggagaaucccgccgacauagggcuuaucgaaucgggccuggcuaaaauuacucacggaaaggauaaacagcacgucaagcauuaccagaagggcgacaucaacuacuuggccauuuggugccucccucaaaauaucacccugaaauccgacaaccacaagaaaagaaagacagauuauauauuuaccgcaauuaaaacuuucgaccuaaacucuaagaauccaaacgaucugaggccgcaucccgcggcuaagcucgugacaaaaguuuacaagggggacacgguggcccuggaggucaauaaccagcuuaauuauuacaucgugaaaagcauccgugcagccaacaagaaauuguauuuucugaagauuaaucagucaagugaguuagcuaacgaaacccaguucaucccugccuacacuaagcucguagauuauaaauuccgcaagguguccguuucuccaacaggagucauuaccgacaaugguccccugcuuaaauga

SEQ ID NO: 2602 - RNA, 3090 nt, Artificial Sequence
  Cas9 variant
augagaagccugagguaccggcucgcccuugaccugggcuccaccucuuuggggugggcuuuauuccgccuggaugcaugcaaccgacccacagccgugaucaaggcgggaguccguauuuucucagacgguagaaauccuaaagauggcaguagccuagcuguuacuaggcgggccgcacgcgccaugagaaggcggcgcgaccgacuccugaagagaaaaacgaggaugcaggcuaaacuuguggagcacggguucuuuccagcagaugccggaaaacggaaggcucuggaacaauugaacccguaugcccuccgugcgaagggccugcaggaggcacugcuccccggugaauuugcccgcgcuuuauuucauauaaaucagagaaggggguucaaauccaaccggaagaccgacaaaaaggauaaugacucuggaguacugaaaaaggccaucggccagcuucgacaacagauggcagagcagggcucgcgcacagugggggaauacuuguggacuagacugcagcaaggacagggugucagggcucgguaucgcgagaagccuuacaccacagaggaaggcaaaaagagaauugauaaaucauaugaccuauacaucgauagggccaugauugagcaggaauuugacgcgcucugggccgcacaggcugccuucaacccaacccuguuucacgaggcugcccgugcagaucuuaaggacacucuguugcaucaacggccccuccgaccugugaaaccagggagauguacacuguuacccgaggaagagagggccccucuggcucucccaagcacccagcgcuuccggauccaccaggaaguuaaucaucuuagacuguuggacgagaaccuaagggaaguggcgcugacgcucgcacaacgcgaugccgucgugacugcucuggagaccaaggccaaacuuaguuuugagcagauacgaaagcuguugaagcucuccggaucuguacaguucaaucuggaagacgcaaaacggacagaguuaaagggcaacgccacuagcgcugcccuggcacguaaagaacuauuuggugcggcuugguccggguucgaugaggcccuccaggacgaaaucguuuggcaacuggugaccgaggagggagaaggcgcacuuauugccugguugcagacacacaccggcgucgaugaggcuagagcccaggcaaucguggacgugucacugccggaaggguauggaaaucucaguaggaaggcucuggcccgcauuguccccgcgcuucgggccgcuguuaucacguacgauaaagcagugcaggccgcugguuucgaccaccauagccaacugggcuuugaguacgaugccucugaaguagaggacuuggugcacccugagacuggggaaauaagauccgucuucaagcagcucccauauuacggaaaggcacugcagaggcauguggcguuuggcucagguaaacccgaggauccugacgaaaagcgauaugggaaaauugccaacccaacaguucacaucggcuuaaaucaggugcgcauggucgugaacgcucugauucggagauacggaaggcccaccgagguaguuaucgagcuagcccgugaccucaagcaaagccgcgaacagaaaguggaggcacagcggagacaggcugauaaucaaaggcgaaacgcccggauccgcagaaguauugcagaaguccugggcauaggggaggaaagggugcggggaucugacauccagaaguggauuugcugggaggagcuuuccuucgaugccgcugaccgaagauguccguauagcgguguccagaucucggcggccauguugcugucugaugaaguggagguugaacacauacucccuuuuuccaagacucuggacgauucauuaaacaaucgcacaguggcaaugaggcaagcuaaccguauuaaacggaauagaacccccugggacgccagggccgaguucgaagcucagggcuggaguuacgaggauauccugcagcgcgcagagcgaaugccacuuagaaagcgguauagguuugccccugacggguacgaacgcugguugggagaugacaaagauuuccucgcgcgugcucugaacgacacgagauaccuaagccggguagccgcagaguaucugaggcucgucugccccggcacccgcgugaucccaggucagcugacagcccuuuugcgagggaaguuuggccugaaugacguuuuaggacucgauggcgaaaagaacagaaaugaccaucggcaccaugcuguggaugcaugugucauuggggugacugaccaaggacugaugcagagguucgccaccgcguccgcucaggcccgcggugauggccuuacaagacugguagacgggaugcccaugccuuggccaacuuacagggaucacguggagcgggcaguucgucauaucugggucucucaccgcccggaccacggauuugaaggcgccaugauggaggagaccagcuaugguauucgaaaggaugggucaauaaagcagagaaggaaagcugacggcagugccggacgggaaaucuccaacuugauucgcauccaugaggcaacacaaccccucagacacggcgugagcgcugaugggcagccucuggccuacaagggauaugugggcgguucuaauuacugcaucgaaauuaccgucaacgacaaagggaagugggagggagagguuauaucaacuuucagggcguauggcguggugcgggccgguggcauggggcgacuaagaaauccacaugaaggacagaacggccgcaaacugaucaugaggcucguaauuggggauaguguccggcuggagguggacggagcagaacguacgaugagaaucguuaagauuagcggcuccaauggucagaucuuuauggcucccauacacgaggccaacguggacgcuaggaauacagauaaacaagacgcauucaccuacacuucuaaguacgccgggucgcuucagaaggccaaaacccgccgggucacaaucagcccuauuggagaagugcgagauccaggcuucaaggguuga

SEQ ID NO: 2603 - RNA, 3090 nt, Artificial Sequence
  Cas9 variant
augaaguacagacuggcccucgaccuuggcagcaccucccuggggugggcuaucgugcaguugaacgcaaaagaugagcccugcgccauugucagggcgggaguucggauauucccugacggucgcaauccaaaggauggaucuucauuagcugugacacgacguaacgccagagcaaugaggcggcgcagagacaggcugcuaaaacggaaggcccgcaugcaacgacuccugaucgaacacgaucuuuuuccggcugacgaggcagccagaaaagcucuggaaacuuugaaucccuaugagcucagggccaaggggcuggaugcggcacugacgccugccgaauuugcucgggcccucuuucauuuaaaccagcgucgcggauucaagaguaauagaaggaccgaccggaaagauaacgacagcggcgcacugaaggcugccauuggugggcuucgagcgcaguuggauacagccggagcagacggccgcgcuagaacuguaggcgagcugcuauggaggcggauguccgauccaaaugugcucaccguccgcgccagauacagggagcagcguaucacaaaagacgacgggaagacccggguggauaaaucuuaugaccuguacguugaucgagcuaugguggaagccgaguuugacgcacuuugggccaagcaagcugaacugucgcccacucaguucggagaggcggcaagagccacauugaaggauugucuccugcaccagaggaacuuacgcccuguccggccagguagaugcacccuggagcccgacgaaccuagggcuccacucgcccuuccgucacagcaacgcuuucggauucugcaggaggugaaucauuugcgacuacugggcgggcgucuccuggaagagagccuuaguguagaacagagagauaaacugguugcagccuuggaggacggauccaagucuuucaaaacggcuauccccaagcuccugggcuuaccugguacugugcaguuuaaccuggccgaugcaaaaaggaccgagcuaaaggggaaugcgacaagcaugcuccugggcaaaaaggacuucuuuggcccagcuuggcacggcuucuccgaagcccgccaagaugagauagucaugcggauccaggaagaggaaucagaggcaagacuuguggacugguuggccaccaguacugggguggacgaggcucaugcccugaagauugcaaacgcugcccuccccgaaggauaugguagccugucugcgaaagcccuugcuaagauccugccugcaaugagggccgaggucauuacauacgauaaagcuguuuuggccgcaggcuaugaccaccacucccauaucucacacgcggccagcaccggggaaauacucccagagcugcccuacuacggagaauauuuacagcgacaugugggcuuugguacgggggagcugaaugauacuccggagaagcgcuucggccggauugcuaacccuacaguacacaucggacuaaaucaagugagagucgugguuaacgcccucauuaaaagguacggccaccccaccgaagugaucgucgagguggcacgugaccugaagcagagucaggaucagcgccgggaaacucaagagcagcaggcuaagaaccagaaaagaaaugagaggcuucgaaaggacgccgcagccaucuuggggauugcugaugaacggguacgccuggcggacauacaaaaacucauccugugggaggaauuaucuuucgauauugccgacagaagguguccauauuccggaguucagcugagcgcagcuauggugcuuucggagcaggucgaaaucgagcauauauugccuuuuucuaugacacucgaugacucccugaacaauaagaccguggccaugcggcuagucaaccgacugaaagguaauagaacgcccugggaugcccgcgaggcuuucgcaggccaggggugggacuacgacgggauucucaugagggccgaacguaugccacgggcgaagagacaaagguuugcucccgauggccuggagaaguggcuuaaagaagacaaggauuucuuggcccgcgcacugaacgacacccgacacuuaucaagaguggcccgggaguaucucagucugguuugcccugcuagcacaagggugaucccaggucagaugacugcaaugcuucgcgccaaauuugggcugaaugauaucuugggccucaacggagaaaagaaucguaacgaccauagacaccaugcgguagaugcuugugucguggccguuaccgaccagggccugcuacagcgguucgcacaagccuccgcugaugccagggggaaaggacuggaccgccucguggagacaaugccggaucccugggacucuuaccgagagcacguccagagagcagugaauagcauuuggguaucacacaagccugaucaugguuuugaaggcgcuaugcacgaggacacuaccuaucggccaccccaucuggacccuaagaacauguggaggacacgcgggaucggaggcgguaaaccaaaugaaaaggaggccgauaguaaagcgauggugggguucaccggccccgaacaccuucagagacaccauagggacaaggccggacaacaguugccguacaaaggcuacguugcauccccuaaguuuugcauggauauuguccggaacgacaaagggcguugggagggagagguggugagcacuuucgaggcuuaucgccuggucucugaauuuggccgagaugccgcuuuagcacacauacagucaaagaguagaagcaucuccgguaagccacucguuaugaggcugcagggaggagacauggugcgguucgaugacgaugaaggccgccccgugguacuuagagucgugaauaugacggguaacggccaaauuuucuucgccccucauaacgaggccaauggggacgcuaggaaccgggauaaacaggaccaguucguuuaccugucuaaguaugcgggaucgcuacagaaagcacgaggcagacgcgugacagucagccccgccggggagcucagggacccaggauuuaaggaauga

SEQ ID NO: 2604 - RNA, 3090 nt, Artificial Sequence
  Cas9 variant
augagaagccugagguaccggcucgcccuugaccugggcuccaccucuuuggggugggcuuuauuccgccuggaugcaugcaaccgacccacagccgugaucaaggcgggaguccguauuuucucagacgguagaaauccuaaagauggcaguagccuagcuguuacuaggcgggccgcacgcgccaugagaaggcggcgcgaccgacuccugaagagaaaaacgaggaugcaggcuaaacuuguggagcacggguucuuuccagcagaugccggaaaacggaaggcucuggaacaauugaacccguaugcccuccgugcgaagggccugcaggaggcacugcuccccggugaauuugcccgcgcuuuauuucauauaaaucagagaaggggguucaaauccaaccggaagaccgacaaaaaggauaaugacucuggagcccugaaaaaggcaaucggccagcuucgacaacagauggcugagcagggcucgcgcacaguaggggaauacuuguggacuagacugcagcaaggacagggugugagggcccgguaucgcgagaagccuuacaccacagaggaaggcaaaaagagaauugauaaaucauaugaccuauacaucgauagggcgaugauugagcaggaauuugacgcccucugggcagcucaggccgcuuucaacccaacccuguuucacgaggccgcacgugccgaucuuaaggacacucuguugcaucaacggccccuccgaccugucaaaccagggagauguacacuguuacccgaggaagagagggcuccucuggcgcucccaagcacccagcgcuuccggauccaccaggaagugaaucaucuuagacuguuggacgagaaccuaagggaaguugcacugacgcucgcccaacgcgaugcuguggucacugcccuggagaccaaggcaaaacuuaguuuugagcagauacgaaagcuguugaagcucuccggaucugugcaguucaaucuggaagacgccaaacggacagaguuaaagggcaacgcuacuagcgccgcacuggcgcguaaagaacuauuuggugcugccugguccggguucgaugaggcacuccaggacgaaaucguauggcaacugguuaccgaggagggagaaggcgcccuuauugcuugguugcagacacacaccggcguggaugaggccagagcacaggcuaucgucgacgugucacugccggaaggguauggaaaucucaguaggaaggcccuggcgcgcauugugcccgcccuucgggcugcagucaucacguacgauaaagccguucaggcugccgguuucgaccaccauagccaacugggcuuugaguacgaugcaucugaaguggaggacuugguacacccugagacuggggaaauaagauccguguucaagcagcucccauauuacggaaaggcgcugcagaggcaugucgccuuuggcucagguaaacccgaggauccugacgaaaagcgauaugggaaaauugcuaacccaacagugcacaucggcuuaaaucagguucgcaugguggucaacgcccugauucggagauacggaaggcccaccgaggugguaaucgagcuagcacgugaccucaagcaaagccgcgaacagaaaguugaggcucagcggagacaggccgauaaucaaaggcgaaacgcacggauccgcagaaguauugccgaagugcugggcauaggggaggaaaggguccggggaucugacauccagaaguggauuugcugggaggagcuuuccuucgaugcugcggaccgaagauguccguauagcggugugcagaucucggccgcaauguugcugucugaugaagucgagguggaacacauacucccuuuuuccaagacucuggacgauucauuaaacaaucgcacaguugcuaugaggcaagccaaccguauuaaacggaauagaacccccugggacgccagggcugaguucgaagcacagggcuggaguuacgaggauauccugcagcgcgccgagcgaaugccacuuagaaagcgguauagguuugcgccugacggguacgaacgcugguugggagaugacaaagauuuccucgcucgugcccugaacgacacgagauaccuaagccggguggcagccgaguaucugaggcucguaugccccggcacccgcgucaucccaggucagcugacagcucuuuugcgagggaaguuuggccugaaugacguguuaggacucgauggcgaaaagaacagaaaugaccaucggcaccaugcaguugaugccugugugauuggggucacugaccaaggacugaugcagagguucgcgaccgcuuccgcccaggcacgcggugauggccuuacaagacugguggacgggaugcccaugccuuggccaacuuacagggaucacguagagcgggccgugcgucauaucuggguuucucaccgcccggaccacggauuugaaggcgcuaugauggaggagaccagcuaugguauucgaaaggaugggucaauaaagcagagaaggaaagccgacggcagugcaggacgggaaaucuccaacuugauucgcauccaugaggcuacacaaccccucagacacggcgucagcgccgaugggcagccucuggcguacaagggauaugugggcgguucuaauuacugcaucgaaauuaccgugaacgacaaagggaagugggagggagaggucauaucaacuuucagggccuauggcaucguucgggcugguggcauggggcgacuaagaaauccacaugaaggacagaacggccgcaaacugauuaugaggcucgugaucggggauagugugcggcuggagguagacggagcagaacguacgaugagaauugucaagaucagcggcuccaauggucagauauuuauggcccccauccacgaggcuaacguggacgcaaggaauacagauaaacaagacgccuucaccuacacuucuaaguacgccgggucgcuucagaaggcuaaaacccgccggguuacaauuagcccuaucggagaagugcgagauccaggcuucaaggguuga

SEQ ID NO: 2605 - RNA, 3096 nt, Artificial Sequence
  Cas9 variant
augcccgccaucuacagacuggcucucgaccuuggcagcaccucccuggggugggcaguguugagguuagagccugccgcgcuggaaccaauugcuauaaucaaggccggaguccggauuuucucugauggucgcaacccgaaagacggcgcaucacuagccguuacacgacgugcugcaagagccaugaggcggcgcagagauaggcuccugaagcggaaagcucgcaugcaggacaaacuugugaaacacggguuuuuccccagugauauggacgagcgaaaggcccuggaaagauuggauccuuaugcgcucagggcaaagggacugcgggaggcccugacuccaggcgaauuugcucgugcccucuuccauaucaaucaacgcagagguuuuaaaagcaacaggaagacggacaaaaaggauaaugacuccggggcauuaaagaaggcuauuucucaccugagacagcagauggaggccggaggccaucgaaccguaggcgaucaccuuuggucgcgcuugcagcaagggcugggagugagagcgagguaccgggagacacccuucacuaacgacgaagguaagaaacgcaucgauaagucauaugaccuauacauagacagagccaugaucgagcaggaauuugaugcacucugggcugcccaggcugccuucaauccugcacuguuucaugaggucgccagggcugaccuuaaagauacccuguugcaccagcgucggcuccgaccagugaagcccggcagaugcacacuguuaccugaggaagagagggcgccacuggcacucccgagcacccaacgcuuccggauuuaucaggaaguuaaccaccuuagacuguugggggaggaccuaagggaaguggcccugacucucgcucagcgcgaugccgucgcaaaugcccuggagaguaaagcucgacuuacauuugagcagauccggaagcuguugaaacucuccggaucugugcaauucaaccuggaagacgccaagcguaccgaguuaaagggcaaugcaacgagcgcggcucuggccagaaaagaacuauuuggugcagccuggggaggguucggcgaggcucuccaggaugaaauuguauggcagcugguuacugaggagggcgaaggggcccuuaucgcaugguugcaagcucauaccggaguggacgaggccagggcgcaggccauagcugaugcaucccugcccgaagguuacggcucacucagucgcaaggcccuggcucggauugucccugcccuuagagcagggguggugacauaugacaaagcgguccaggccgcuggauucgaucaccauagccagcugggcuuugaguacgacgccggugaaguugaggacugggugcacccagauacuggggagaucaggcccguauucaagcaauugccuuacuauggcaaaccacuccagcgacacguggcauuuggaucuggcaagcccgaagacccggaugagcgccgguacgggaagauugcuaacccuaccguccauaucggacugaaucaggugagaacaguugugaacgccuuaaucaggcguuauggucgccccaccgaagucgugauugagcuggcacgggaccuaaaacaguccagagagcaaaagguagaagcccagaggaaacaggcugagaaucagcgacggaacgcgcgcauaagaaagucaaucgccgaaguucucggcauuggggaggaacaagugaggggagcagauauccagaaauggauauguugggaggagcugagcuucgacgucgcugaacggcgaugcccauacaguggcgugcagauuucugccagaaugcuuuuguccgaugaggucgaaguggagcacauccugccuuuuagcaagacgcucgacgauucgcugaauaaccgcacuguugccaugaggcaggcuaaccguaucaagcggaauagaacacccuggaccgcaagggacgauuucgaagcccaagguuggucuuaugaggggauuuuacagcgcgcggagcgaaugccacugagaaaacgguacagguuugcucccgacggcuaugaacgcuggcuuggagaugacaaggacuucuuggcccgugcacucaacgauacuagauaccugucccggguggccgcugaguaccuaaggcugguauguccuggcucagggacacgcgucaucccaggacagaugaccgcacgacucagagguaaauuuggccugaauggggugcuuggaccggacggcgaaaagaaccggaaugaucauaggcaccaugccguugacgcgugcgugauuggugucacggaucaaggguugaugcagcgcuucgcuaacgccagugcacaggccagagaggacggccugaccagguuaguggaugacaugccccggccuuggccaacauaucgugcucacguagaacgcgccgugcgacacauauggguuagccauagacccgaucacggauuugagggcgcaaugauggaggaaacuuccuacgggaucggaaaagacggcucuauuaagcagaggcggaaggcugaugguagcccugggcgcgagaucaccaaucucauccggauucaugaagccacacaaccacagaggcacggagcgggccccgacggucagccgcugccuuauaaaggcuacgucgggggaucaaacuauuguauagagaucacucggaaugauaagggcaaaugggagggggaagugauuaguaccuuccgagccuacggaaucgugagaacauccggccuuggucagcugcgccacccaagggucgggcaaaacggacgggaguugguuaugcgucucgugauuggcgacagcgugagacuggaaaucgacgguauagagaggaccaugcgcaucguaaagauuucuggcucaaaugggcagaucuuuauggcacccauucaugaagcuaacgucgaugcccggaauagugacaaacaggaugcuuucgcauauacuagcaaguacgccggaucccuacagaaaacgaaggcccgauucgugacaaucucuccuauaggcgagguuagagaccugggguuuaagggauga

SEQ ID NO: 2606 - RNA, 3099 nt, Artificial Sequence
  Cas9 variant
augaagaaaagaauccugggccucgacauugggauagccagcgugggaugggcucuugucgaguucgaugacgaauuucaggauaacaagaaaaaggguaccaucauuaaauccggcguuaggaucuucacacgggcagagacucccaaggaacgcgagucucuggccaagccucgacgugaagcgagaucacaaaggcggcgcauuagaaggcggguggagcgcuugaauaguauccgagaguuauuuguaaagaacgggguggucgaagaguggagcguguccaagaaaaauccaaacaauauauacaucacgcugaaccagauuaagaccccguggcagcuaagaauggaaucucucgacaggaaacugacaaaugagcaguucgcuguugugcuuacucaccuggccaagcaucggggauauaagucguugcguaaagaugacaaggcaggcaaaguccucgaggccaucucacaaaacaagaaacgccugaaugauagcgacuacagaacccugggugaaauguuuugcaagaacgagaguuauaaagaacacaagaggaauaaagggggagaguacauuaacuccguggcucgggaacucaucgaggaggaaguagagaaaauauucguuaagcagcgagaaaaaggcaauaacuuugcagaugugaauacagagcgcgaauauuuaaagauugccuucucucagaaacccgcuggcagcaucuccaagauggucggguuuuguaccuucgagaacggagagaagagagccccuagggacucauacagugcggaacuguuuaaagugcuuugcacuauuaacaauacaaccuucacggauaugaagacuggugagauccggagcuuuucuaaagaagagaucggcaagaccuuggaaacagugaaaaacgucaaggacguuaaguaugcaaaaauucgcaaggaucuggggcuagaggacuccgugaaauucucaggaguagacuacagagagaaugccaagagcaaaggcgaaggugagauauucgugaguaugaagacuuaccaugaaaucaagucuaaaauugagaagcucuccaaagagaagugggauaaccugaaagggaauaccgaacuucuggacagcaucgucaacauaauugcuaauuugaaggaugacgagucgaucaaaaaggaauuucagaagcucaaaaucgaugaggacauuaucgaugugcuguuaaacuucgaauuuaagaaauucauuaaucugucuuuuaaggcccucaggaaaauaaucccauuccaauuucagggacagaaguauauuacagcauccaccucagcuggcuacagucuuaagcaggagggcaucaaaaacaagcugguucccccugccaaagagaauaucaacguggcggucguggcccgugcauucgcucaaacgcggaagguaauuaaugccguuauacgaaaauaugggcaguuugaccagaucaacauugaauuggcuacugagcuaaagaauagcaaguucgauagauccaaaaucgaagagggacaaaagaaauuucagucucagaaggacaaaauuuucaaggaagugcaggagcugagggguggcaugacaccaagcucaagucuccugcuuaaguaccgccuguggcgggagcaagaugaaagaugugucuauuccgggaggaaaaucagcuuugaggacuugcucgacaccggauuccuggauauagaccacaucauucccuacucuaagucaauggaugacaguuucaacaacaaaguguuaugccuggccgaagagaaucgcaacaagaaaaaugauaucccuuuuaacuauuaccagcgaauugaccgggauuggaaucuacucaucagcauaauuacuuccaugaagaacaugaaaaucgcaaagaagucucgucugcuuaaacaggaauugucggacauugagggcuucaucgagagaaauauaaacgauacaagguacgccacccgcuauaucaaggacuuucuggaaaauaaccucgaguucaaagaaaaugaguuuauuaaggucaaagugcaggcucggagcggugggcugacguccguucuuucauacaacuggggcaugaguaaggauagagaggaaucuuauuuccaucacgcgaaggacgcaaucauuguggccuguagcacccaaggaaugguacaguacaucuccaaaauaucacagcaguaugagaaugauaaggacaaaaugaagaaaauuaaggacaagacagaaaacugcaucccaaaaccgugggauagcuuuagggcugacgucgaggaaucuaucgagggcauuuucguguccuuugcaccccgacacaagguuacugggagugcccauaaagagaccaucuacagcaagaaacaccuggaaaaggagcgcuaugugacagucaagaaaucuuuggauaagauuaaacucuccgaccuggaaaauauaccuuguaacgagaacugcggaaucauucggguguuaaaggaaagacuggagaaauucaagaaugauucacuaaaggccuuugcugacccaguacauaugcccacuaaauguccuaacaagaaagguccagugaucaggaguguuaagauuaaagagagcaauaagaccggcaucgaaguccguaaagggcucgccgagcgcggagaaauggugcggguggaugucuucauaaaggacaagaaauacuaccugguucccaucuaugugucggauuuuaagaacaaagaccuuccgaauaaggcaauugcggcuuugaaacuggagaacgaauggaucaugauugauaagacauacuccuucaaguucucucucuuuaaagacgaucugaucaagauuaaaaagaaaaaggaggagauauucggcuauuuugguggggugcacagaagcaccggcacuaucaagaucaaaucaaggcacaagccuaaagaaauugacgagggaauaggcagucgaugcuuacuggacuuccggaaguuucaaguagauguccuugggaauuacacggaagugaaacaugagaagcgcaugcccgccuauaucacaagaaaggacaaaaagcacuga

SEQ ID NO: 2607 - RNA, 3105 nt, Artificial Sequence
  Cas9 variant
augaagauccugggcuucgacauugggauagccagcaucggaugggcuuuuguggagaacggugaacucagagauugcggcgucaggauuuucaccaaagcagagaaucccaagacaggggacucccuugccaugccucggcgcgaagcgcgaucuguucguagaaggcuggcucggcgcaaaggaagauuggagacuuuaaagaggcugcuagccaaagaaugggaucucuguuacgaggacuauaucgcagccgauggcgagcugccaaaggcuuuuauggguaagaaccuuacgaauccguacgugcugcgguaugaagcauugcagcgccuccuggggaaagaggaacuggcccgaguaauucuccacaucgcuaagcauagaggauacggcaacaaaaaugccaagauaaccaaaucagaggagaguaagagggaacaaggcaagaucuuaagcgcgcuggcaacaaacgccuccgugauugcucgguaucguacugucggggaguacuucuauaaagaauuuugcgaggugaucaagaauccccagggacuuaacaccaaugaaaacuguacacagccuaaaguucgcguguugaagccaauuagaaauaaagguggcgaguacaccaacugcauccugcaggaggaccuacaaagggaacuccgguguauauucgagcaccagaagggguuuggauuccccauuacucaggaauuucaggauaaaauccugaagauugccuucuaccaacgaucucuuaaggacuuuucgcaucuggucggcaaaugcacauucuauccugaugagccacgcgcacccaaguuuucauugagcgcuaucgaguucaucaccaaagccaagacgauuaaucuccugguggguauaguaaaagagaguggggagguuugggacaaggaacaguggagagagagguuagauuccguguucucugcggucugugaacggggaaaccugacuuuugcccagaugcgcaagauccucaaaauugacgagagaauccaguucaaggaaguggauuacaccgcaaagaauccugagaacaagaaauuuguggaguucaagaaccuuaagaaauuuugcgaaauacugggcgcuauugucggcgacagggccuuggcugacagcaucgcccgugauaugacacuaaucaaggacgaggaagaacuggcacaaaaacuccggggguauggaaaguucucccaggagcagauuacucaacugggugcccuuaauuuuucacaccauaucaaccugaguuugaaagcucucagcgaaauucugccauucaugcgagagggcaugagauacgaugaagcgugucaggaggcaaaguuacaggccaagcacaaugacaaaaagucuaaauuucugccgcccuucugcggguccauauaugcugaugaacuaaccaacccuguugugcacagggccaucgcagaguaccgcaagauucucaaugcccugaucgcuaaauauggaaacguacauaagauccacauugagcuuacacgggacgugggcaaaaauuuucaggaaagagagaaguacaagaaagaaauagagucaaacuacaaggccaggguccaagcaaugcaggaaugugagaaauugggucugacccucagcgaggggaauauccugaaacuucgccuguucauggaacagaacgagcgaugcguguauaguggccggaaaauuacguuggcgaaucucaaggaacagggagcucuggagaucgaucauauuuuaccauacucucguuccagcgacgauucguauaugaacaagguucugguguuuacuaaugaaaaccaaaauaaaggcaacaagacacccuacgaggccuucgggggagacucucagaaauggggugagaucgaaucccuagcacucagaucaggcuauccuaagaaaaaggccaagaggauacuggauaaaggguucggagaccgcgaggcuggcuuuaagagucggaacaucgucgacagcgguuacauugccagacuuaucgcaaauuauaccaaagaauacuugaaguuccugccacucgauucccacgagaacacugcucugauugccggggagaaagacucuaagauccacguggaagcgguaaagggcauguuaacagccaccaugaggcauuuuuggggacugggcagcaaaaaucgauacgagcacacgcaucacgcuauagaugcaauuaucauugccuauaucaacgcugccaugauacagcgcuucucacaguuucggcaaaaucaggaaagucuuaaggcaagauucuacgcgaaagaguuggccaaggaagaguuuaaaacccagagggcuuucuuugagcccuucuccggguuucgugaacagguucucgccaaggugggacaaaucuucgucagccgcccgccucggaaaagagcaaggggugcucugcaugaggaaacauuuuauucuauugacgauaagaagcuaucagagacuuacggcgggaaagaaggagugcagcgagcccugagucucggcaagauccggcagauugguaccaaaaucgucgcaaacgggcccauggugcgcguugacauauucaagcacaaaaagagcggcagauucuaugccgugccaauuuacacaauggauuuugcucugggaauccuuccuaauaaggcgguagucuccggcaaagacaacgauaggaucauuaaggacugguuggagauggauucuaauuaugaguucugcuuuucgcuguucaaagacgaugugaucgaaguucaaaagaaagacauggagaagcccgaauuagccuacuuugugagccucaacacuuccucagcaaguauugcucuggucaagcacgacaauaaauucgagacccuuacaucuaaccaggccaagcuguuuagcaaugccaaagaaaacaaugugauagcugaguccuuggggauccagaaccucaagguauucaaaaaguacaaggugucaccacugggagagauuaaagaagcaaaguaugagccccggcagccuaucgcccuaaaaaccagcccaaagaaacaucgaaagcaaaacaaugcgcaguga

SEQ ID NO: 2608 - RNA, 3108 nt, Artificial Sequence
  Cas9 variant
augagaaggcugggccucgaccuugggaccaacagcaucggauggugccuguuggauuuaggugacgauggcgagcccguguccauuuuccggacaggggcccgcauauuuucugacggacgagauccuaagucacugggcagucuaaaagcuacucguagagaagcaaggcucacgcggcgcagaagggaccgguucauccagcgccaaaagaaucugauuaacgcccuugucaaauacggucugaugccagcggaugagauccagcgacaggcuuuggccuauaaggacccguaccccauuaggaaaaaggcacucgaugaagccaucgacccuuaugagauggggagagcuauauuucacaucaaucagcggcguggauucaagagcaaccgcaaauccgcagauaaugaagccggcguugugaagcaaucuauugcugaccuggagaugaaacugggcgaggccggggcgagaaccaucggagaauuucucgcagauaggcaggccacaaacgacacuguacgggcucgacgcuuaucggguaccaaugcccuguacgaguucuauccagacagauacaugcuugaacaggaguuugauacauugugggcaaagcaggcugccuucaaccccucacuguauauugaggcggccagggaacggcuaaaagagaucguguuuuuccaacgcaagcucaagccucaggaagucggcagauguauauuucugagcgacgaggauaggauuaguaaagcacuuccauccuuccagcguuuucggaucuaccaggaacugucuaauuuggcuuggauugaccaugaugggguggcccaccgaaucaccgcuagccucgcccugagagaccauuuauucgaugagcuggagcacaagaaaaagcucacuuucaaagcaaugagggccauccuucgcaagcaaggaguuguggacuaccccgucggcuuuaaccuggaauccgauaaucgggaccauuugauugguaaccuaacaucaugcauaaugagagaugcuaaaaagaugaucgggagugcgugggacaggcuggacgaggaggaacaggauagcuucauucucaugcugcaggacgaucaaaagggagacgaugaagugcgcucuauccuuacccagcaguauggccuguccgacgauguagcagaggacuguuuggauguucgacucccugacggccacgggucacugagcaaaaaggccauagaucggauuuuaccagugcugcgugaccagggacuaaucuacuaugaugcugucaaagaggccggucucggcgaagcaaaucuguacgacccguaugccgcucuuagugacaaguuggauuacuaugggaaagcccuggcaggacacgugaugggcgcgucugguaaguuugaggacuccgaugaaaagagauacgggacgaucagcaaccccacugugcauauugcucucaaucaagucagggccguugugaacgagcugauccgccuucacggcaaaccugacgaaguagugauugagauaggacgggaucugccaaugggcgcagacgggaagagagaguuggaaagguuccagaaagagggacgagccaagaacgaacgcgcucgggaugagcucaaaaagcugggucauaucgacucgagagagucuaggcagaaguuucaguuaugggaacaacuggccaaagagcccgucgaucguugcuguccuuucaccggcaagaugauguccauuucagaccuauuuagugauaaaguggaaaucgagcaccuccugccauucagccuuacauuggacgauuccauggcaaauaagacuguuugcuuucgccaggcuaaccgggacaaagggaauagagcccccuucgacgcguuuggaaacucuccggccggcuacgauuggcaggaaauccuggguaggagccagaaucucccuuaugcuaagcgauggcgguuccugcccgacgcaaugaagcgcuuugaggccgaugggggcuucuuagagagacaacugaacgacaccagguacauuucacgguauacaaccgaauacauaaguacgaucauuccuaaaaauaagaucuggguggucacuggacgacuuacauccuugcucagaggcuucugggggcugaacagcauucuacgcggacacaauaccgaugacgguacuccagcuaaaaagucuagggaugaccaucgucaccaugccaucgaugcaauagugguaggcaugacaucacgggggcugcuccagaaaguuaguaaggcggccagaaggagcgaggaccuggaucuuacccgcuuguuugaaggacgaaucgaccccugggacggcuucagagaugaggugaaaaagcacauugacgcuaucauugucucccaucggccaaggaagaaaucucagggugcccugcacaacgauacggcauaugggaucguggaacacgcugagaauggcgccucgaccgucgugcaucgcguucccauaacuagcuuaggaaagcaguccgacauugagaaagugcgugauccucucaucaagucagcacugcuuaacgaaacagccggccugagugggaaaucuuuugagaaugcuguacaaaaguggugugcggacaacagcauuaaguccuugagaaucgucgaaaccgugucaauaaucccaauuacagauaaagagggaguugccuacaagggcuauaaaggugacgggaaugcauacauggauaucuaccaggacccgacuagcucuaaguggaaaggagaaauugugucccgguucgaugcuaaccagaagggcuuuauccccaguuggcaaagccaguucccuaccgccaggcucauaaugcgccugcgaauuaacgaccuacugaagcuccaggauggugagaucgaggaaaucuauagaguccagcggcugucuggcuccaaaauucuuauggccccacacacagaggcuaauguggacgcaagggaccgcgauaagaacgacaccuuuaaauugacuucaaagagucccgggaaacugcaaagcgccucggcgagaaagguacauaucuccccuacgggauuaauuagggaaggcuga

SEQ ID NO: 2609 - RNA, 3108 nt, Artificial Sequence
  Cas9 variant
auggagcagcugaacuacauccucggccuugacauugggauagccagcgugggaugggcugucguugaaaucgaucacaaugaggaccccauuagacugaucgauguggguguaaggaccuucaacaaggcagaaguggccaaaacaggcgaguccuugucuuuaauucggcgccuggcgcgagggucacguagacuggucaggcggaagaaaaugcgccuccugacugcuaagagacuucugaaaagugaaggaaucuugagcgaccucgauuuuaauaagggcgccauacugaaccugccuaauaacugcugggagcucagggugaaggguuuagacaaaaagcuguccgauaaagagugggcagccguucuuuugcauaucauuaagcaccggggguaucugucucagcgcaaacaugaccgaaagacggaugacaaggaacuaggagcucuccugucgggcgugucaaagaaucacagccuucuggaggaaggcgaguucagaaccgcagccgaguuggcuaucaacgucuuuuguaauaguaaggggcauauuaggaaccaguggggagauuacucccacacauucucucggcucgaccugcagaaagaaaucaagcaguuauuugugagccaacgugagcuggguaauccauauacuuccucaaguuucgaagagaacauaauuagccuccuuaugaaacagaaggaagccaucucuggcaaugauauucugaaaauguuggggaagugcaccuacgagaagaacgaguauaaagcggcaaagaauacauacuccgccgaacgcuuuguauggcuaaccaaacugaacaaccucagaaucguugacgacggaguggagagggcucuaaauucaagcgaacggaaacuucugaucgaugagccguauaaaaaggccaaguugacuuacgcacagguccgaaaaauucucgaacugcccgacagugcuguguucaagggcgugcgcuacuuugccgauaacgcggagucuuccacauuaauggagaugaaauucuggcacagcauaagaaaggcccuggaaucgaauaaccuaaaagacgaguggcucguccugaagaccaagccugaacuuuuggaugagaucgguacgggguuuucuauuuauaaaacugacgaugacaucaccuccuaccugucaaauaagcucgauaaaaagguucuggacauacuucugguggaaguaaguuucgauaaauuuauugaguugagccucaagugucugaggaagaucaucccauuaauggagaaaggauaucgguacgacgaagcauauaaguacauuuauggcgaggugaacaucgaauacaaucugaacgacauuaaaaaucccgucgugcuacgcuccuucucucagagcagaaagguuauaaacgcugugaucaggcucuacggcaguccugcccguauucauaucgagacagcucgggauaucgggaaaucauucaaggagcgaaaagccauugaaaagcaacaggagaagaauagacuggaaaaagucagggcagccgagcacuuuaagcagcuuuucccaaacuaugugggagaacccaaagcuaaggacauauugaaaguacgccuguacgagcagcaacaggguaagugccucuauuccggcaagauccuggauauuaaacgguuaauggagcauggguacguugaaaucgaccacgcgcugccuuuuagcagaacuugggaugacucuuucaauaacaaggugcuugucuuggcaaaugagaaccagaacaaaggaaauaagaccccauaugaaugguuuaacggcaaagauaauucagacaguuggaagagguuccucgcccuggugaacaauagcgguuuuuccgcugucaagaaacaacacauucuaaugaaggagaucgaugaagagggguucaaacagcgcaaccugaaugacacacgauacauaacccgguuucucuguaacuggguggagaauaacaucccgcugcuuggcaagggaguuaaacguguguucgcaccccagggcaagauuacggccuugcugagaucuaauugggggaucaggaagguacgcgaagauaacgaccggcaucacgccauugaugcuaucgucguggccugcacuacaguuucgauacagcaaagaauuaccaauuaugugaaaaacagcgagaucaauaggaagauuaaacgacagaacuacuuaaaguuuccugaaccauggaaauucuuucgcgaggacaucuccauacgggucuucucaaacaaucccaucgaggaacucaagcagcagcugagugacagaccugaggcaaaccaucaauucgugacuccacuuuuuguaucuagggcgcccgugcguaaaaugacaggacagggucacgaagauaccauucgcagcgcuaagcggaucuccgagggcauuucaguucugagagucccguugacgaagcucaaugacaaaagccuggaacuaauggugaacagggagcgagagaaggaacuguacgaugcccucaaacagcggcugcuugaguucaagaaugacccugaaaaagcauuugccgagcccuucuauaagaagggaggacagcaagugaaaaccguccgcaucgaaagaguucagaagaacggcguguuggugaauaacaauacagguauagcugauaacgggaauauuguaagggucgacguguuucugaaaaagaaaaaguacuucuuaguuccaaucuauucuuggcaaguggccaagggcauccucccuaacaaagcaauugucgcucauaagaaugagugugauugggccgacauggauggauccgcgcaguuucuguucagucuuuacacuaacgaccugaucgaggugguucuaaaagauagcaccauucucggcuauuuuucuuccauagaccgggccacagcugcaaucauuaucaaggaacccgauauggagaaaucaaaggggaaggaagggauucaccgaguggguguaaaaacugccagaaguuucaucaaguacaaugucgacgugcugggcaaaaacauaagccgcugcaggaaggcuaaacguuugccagugcgguga

SEQ ID NO: 2610 - RNA, 3108 nt, Artificial Sequence
  Cas9 variant
augcugagaaagaugcacuacaggcucgcccuugaccugggcagcaccuccuuggggugggcuaugauccgguuaaacgcaggaaaugagcccugcgccgugauuaaagcggguguccgcauauucucuaacggccgaaauccuaaggaugggucaagucuggcuguuacacguagagaagccagggcaaugcggcgcagaagggaccggcuacucaaacgcaaggcccgaaugauccagacucugauugaguauggauuuuucccagcuaaagaagaucaaagaaaggcacuugagaucaugaacccguuugcccugagggcuaagggcuugaaugaagcccucacgcccgcggaguucgcacgggcccuguuucauauuaaccagcgucgcgguuucaaaagcaauagaaagaccgacaaaaaggauaacgacuccggggcucugaaaacagccaucaauaagcucagggagacuuuaaagaccgaaaacugucggacagugggagaguggcugaauaaacgagauguagcaggccuuaccgugcgcgcuagauaccaccaggacaagacuauaaaagaagauggcaagucuaaaaucaacaaguauuacgacuuguauauugauagggccaugaucgagcaugaguuugacgaacuguggaaaaagcaggcggagcuaaauccuacacucuucaccgaagccgcacgggcugaucugaaggacguccuucugcaccaacgcgccuugaaaccagugaagcccgggagaugcacguuuaugccugacgaggaaagggcuccacucgcccugcccucgacucagcguuuccggauguaccaggagguuaacaauuuacgaauacugagagauggacucaaagaggaaucacuuacccugaaccagagggacgauuugaucgcagcccuagaggaaaacaauaagcgcacauuuacucaaauuaaaaagcugcucggucugggcgggguggucaaguucaacuuugaggacccuaaacgggaggaacuuaagggaaauaccacaagcgcuauucugggcaaagaugagcauuucgguagugugugguucaaguuugacgaagcgaaacaggaugcaaucguaaugcaguuguucaaggaggaaaacgaggccaagcuccugagaugguuacagaaugaaaccgggauugacgagaaaagggcugagacgaucgccaacguuggacugccagaaggcuauggcucccuaugugcacucgcccuggcucgcauccuuccggaguugcgacgggaugugguccccuacucugacgccgcaaaggcggcuggguuucaccacagcgauacuuccaauaaccaagaagugccuggacugacauucccaauugagcucguggucaccgagacuggugaaauaaaaacaaagcauaucuuucacgagcugcccuacuauggcgaauaccuucagcgucauguuggguucggaucaggcaaaccugaggacagugccgaaaagagauaugguaagauugcaaauccaaccgugcacaucgggcugaaccagguaagguugguggucaauacgcucauaaaacgcuacggccaccccagcgaggugauuguugagguggcccgggaccugaagcaaucuaaagauuuaagagacgaagagggaaagaggcaggcugaaaaccagaaacgaaauaagcgcauccggaccgccaucgcaggcguccugcagacauccgaggaaagagugaggcgugaugacauugagaaaaugauccuaugggaggaacucucauuugauccggcugaccgccggugcccuuauagcgggguacaaauuagugccgcgaugcugcuuucugaugagguugaaauagagcauaucuugcccuucucccagacucuggacgauagccucaacaauaagaccguggcccugagacaggcuaacagggucaagggaaaccgaacaccaugggaagcauuuggugcccagucgacugcuggcuucgacuacgccaccauuuuagcacgggcggagcacaugccuaaagggaagcgcuauagauuugccgaggauggauaccaaagguggcugaaagacgaugcuggcuuccuuccccgggccuugaaugacacacgacauaugucuaagguggcaagagaauacaugucccucaucuguccaaacacccgcgucauccccgguaggaugacugcuaugcugcgugggaaauuuggccuaaaugacgugcugggacucaacggcgagaagaaucggaacgaucacagacaucacgccguugacgcaugcgugauugccguaacggaucaggggcugcuucagagguucgcuaaggcgucagccagugcacgcgaacagcaauugaaucgacuggucgagaacaugccuuuaccaugggagagcuauagagaacacguggagcgggcuauagacgccaucuggguuucccauaaaccggaucacucucaugaaggagccaugcacaaugacacagcuuacggucuccugggcgaugggaaggugagcauucacaaaauggucgagggaaagagggaacgcaucgaggagucacuuaaagugauugcauucaccaacgccaaggcgaaugaccgucauggccuguuggauaacggugaacccagaccuuauaagggguacaaaggcgacaguaauuauuguaucgagauaauccggaacgaaaagggaaaaugggagggcgaaguaauuuccacuuuugaugcuuaccagcucgugagggagcacgggguugcccgccugcgacauccaacccuaagcgucucuggaaagccccuggugaugagacucaugaaagacgagacaauccggauggugaccaaugaaaagccuauuacugcaagggucugcuggguucgcucagauacaagaaucgccuucgcuaguacgagcgaggcaaacguggacgccagggaccgggauaagaacgacuccuuuucuuauauagugaaaaccgcgucgguacugcagaaacuucaggcucgucgcauuagcaucuccccaacuggcgaauugcgagaucccgguuucaaggaguga

SEQ ID NO: 2611 - RNA, 3108 nt, Artificial Sequence
  Cas9 variant
auggagcagcugaacuacauccucggccuugacauugggauagccagcgugggaugggcugucguugaaaucgaucacaaugaggaccccauuagacugaucgauguggguguaaggaccuucaacaaggcagaaguggccaaaacaggcgaguccuugucuuuaauucggcgccuggcgcgagggucacguagacuggucaggcggaagaaaaugcgccuccugacugcuaagagacuucugaaaagugaaggaaucuugagcgaccucgauuuuaauaagggcgccauacugaaccugccuaauaacugcugggagcucagggugaaggguuuagacaaaaagcuguccgauaaagagugggcagccguucuuuugcauaucauuaagcaccggggguaucugucucagcgcaaacaugaccgaaagacggaugacaaggaacuaggagcucuccugucgggcgugucaaagaaucacagccuucuggaggaaggcgaguucagaaccgcagccgaguuggcuaucaacgucuuuuguaauaguaaggggcauauuaggaaccaguggggagauuacucccacacauucucucggcucgaccugcagaaagaaaucaagcaguuauuugugagccaacgugagcuggguaauccauauacuuccucaaguuucgaagagaacauaauuagccuccuuaugaaacagaaggaagccaucucuggcaaugauauucugaaaauguuggggaagugcaccuacgagaagaacgaguauaaagcggcaaagaauacauacuccgccgaacgcuuuguauggcuaaccaaacugaacaaccucagaaucguugacgacggaguggagagggcucuaaauucaagcgaacggaaacuucugaucgaugagccguauaaaaaggccaaguugacuuacgcacagguccgaaaaauucucgaacugcccgacagugcuguguucaagggcgugcgcuacuuugccgauaacgcggagucuuccacauuaauggagaugaaauucuggcacagcauaagaaaggcccuggaaucgaauaaccuaaaagacgaguggcucguccugaagaccaagccugaacuuuuggaugagaucgguacgggguuuucuauuuauaaaacugacgaugacaucaccuccuaccugucaaauaagcucgauaaaaagguucuggacauacuucugguggaaguaaguuucgauaaauuuauugaguugagccucaagugucugaggaagaucaucccauuaauggagaaaggauaucgguacgacgaagcauauaaguacauuuauggcgaggugaacaucgaauacaaucugaacgacauuaaaaaucccgucgugcuacgcuccuucucucagagcagaaagguuauaaacgcugugaucaggcucuacggcucacccgcccguauucauaucgagacagcucgggauaucgggaaaaguuucaaggagcgaaaagccauugaaaagcaacaggagaagaauagacuggaaaaagucagggcagccgagcacuuuaagcagcuuuucccaaacuaugugggagaacccaaagcuaaggacauauugaaaguacgccuguacgagcagcaacaggguaagugccucuauuccggcaagauccuggauauuaaacgguuaauggagcauggguacguugaaaucgaccacgcgcugccuuuuagcagaacuugggaugacucuuucaauaacaaggugcuugucuuggcaaaugagaaccagaacaaaggaaauaagaccccauaugaaugguuuaacggcaaagauaauucagacaguuggaagagguuccucgcccuggugaacaauagcgguuuuuccgcugucaagaaacaacacauucuaaugaaggagaucgaugaagagggguucaaacagcgcaaccugaaugacacacgauacauaacccgguuucucuguaacuggguggagaauaacaucccgcugcuuggcaagggaguuaaacguguguucgccccucagggcaagauuacggcauugcugagaucuaauugggggaucaggaagguacgcgaagauaacgaccggcaucacgccauugaugcuaucgucguggccugcacuacaguuucgauacagcaaagaauuaccaauuaugugaaaaacagcgagaucaauaggaagauuaaacgacagaacuacuuaaaguuuccugaaccauggaaauucuuucgcgaggacaucuccauacgggucuucucaaacaaucccaucgaggaacucaagcagcagcugagugacagaccugaggcaaaccaucaauucgugacuccacuuuuuguaucuagggcgcccgugcguaaaaugacaggacagggucacgaagauaccauucgcagcgcuaagcggaucuccgagggcauuucaguucugagagucccguugacgaagcucaaugacaaaagccuggaacuaauggugaacagggagcgagagaaggaacuguacgaugcccucaaacagcggcugcuugaguucaagaaugacccugaaaaagcauuugccgagcccuucuauaagaaagggggacagcaagugaagaccguccgcaucgaaagaguucagaagaacggcguguuggugaauaacaauacagguauagcugauaacgggaauauuguaagggucgacguguuucugaaaaagaaaaaguacuucuuaguuccaaucuauucuuggcaaguggccaagggcauccucccuaacaaagcaauugucgcucauaagaaugagugugauugggccgacauggauggauccgcgcaguuucuguucagucuuuacacuaacgaccugaucgaggugguucuaaaagauagcaccauucucggcuauuuuucuuccauagaccgggccacagcugcacugaucauuaaggaacccgauauggagaaaucaaaggggaaggaaggaauccaccgaguggguguaaaaacugccagaaguuucauuaaguacaaugucgacguguugggcaaaaacaucagccgcugcaggaaggcuaaacgucugccagugcgguga

SEQ ID NO: 2612 - RNA, 3111 nt, Artificial Sequence
  Cas9 variant
augagaaucuucggcuuugacauugggauaaccagcaucggaugggccuacguggaguccaacgaacugaaggauugcggugucaggauuuucacaaaagcugagaaucccaagaacggcaaaucucucgcacuuccucggcgcgaagcccgaggggcgcguagaaggcuggcucggcgcaaggccagauugaaugcaaucaaaagguuacuguguaaggaguuuggacuaaacguuucagacuauuucgccaaugauggcgaacucccaaaggcuuacgagacuacgaaagacaccaagaguccguaugagcugcggagccuugcacuggaacagaaauuggagcccaaggaacucgcccgcgugauucugcacaucgcuaaacaucgagguuacgggaacaagcacgccaagacaggauccgauaaagacucuggcaagguacugucggcgauaaaagugaaugagacugcaaugaaggauaaauaucaaucagucggcgaguaccucuauaaggaauuuuaccagaaauuaagacuggagagcgaaaagaaggggaacaauaucaccaaagaguucaagaacgugaggaauaaaggagaaaacuacgagcauugcguugcccaggaacaggugcgggcugaacuugaguugauuuuugccaagcaaaaagacuucggugcaacauuuagugaaaauuucgagucccagaucauugaaaccgcuuuuuaucagcgugaucugaagucuuucgaggacaaggucggcaaauguguguuuuacgagaacgaaaaucgcgccccuaaggauagccuauccgcgauggaguucguagcccucacuagaaucauaaacacacugaaaaaccuugaagagaagucaaagaaucuggggauuggagaaguuuauggcaaggacaagauccaggagauuuugaaaaucgugcucgauaagggugagaugaguuacaaaaagcugagggaaaucuuacaccuggacgagcauauucucuucgcaaaagacagcaaacuugauuauacccaagggguccaggaagcugagaaggccaaauuuauagagcugaagaacuugaaggcuuucaagaaagccaugggaggcgacuuuucuaauuucgcacgggaggagcuagauaagaucgccacggacauuacucuggugaaauccaaggaaaaccucgcuaagaaacugcagaauuacucagcgcuuagcaaggaacagguggaagcacugaguaacuugucuuuugccaaacacaucgaucucucccugaaggcuuuagagcaaauacugccauucaugcgaggcgacaaaaccgggaagugccuacgcuaugaugaggccgucaagaaagcagaacuccaggagcacagaaagcauaaacagaagggagaauuucugauuccccuuaaagacuacgagccuuacuuggccaauccaguuguggcuagggcccugagcgaauaucggaagguacucaacgcacugcuucgcaaguacgguaaagugcacaagauccaucuggaguucacaagagaggcgaaauugucggcuaaggaaaggcaaaaauaugagaaggaacagaaggagcacuuugaagccaaucagcgugcaauccagcaaugugagauucucggccugcccaucaacgggacuaauauuuuaaaaaugaagcuguggcuagagcagggagaaugcugugccuacucuggcgagaaaauaacccgggaacaccuccuggauuccaacgcccuucaggucgaccauaucuauccuuacucacgaaguuucgaugacagcuauaugaauaagguguugguuuuugcuaaagagaaccaggacaaggguaauaaaacaccauucgaggcauuugggggcgauaaggaaaagugggacaggauucugucccucucugcuaaacugccgaagcaaaaacagagacgcaucagcaacaccaacuucaaggauaaagagggaggcuucuuagcccggaaucugaacgacacgggguacaucgcgaaacuugccucacaguggacuaaggauugcuuggaauuugaggaccucagagaaaaugaggugacaauugcuggagagaaagguaguuccguccacauagaagugguaagcggccagcugaccucuaugcuaaggcauuacugggggcugggaaacaaggaucgcaauaaccaccuccaucacgcaguugacgccgugauccuggcuuauacuaauaacgccaugauuaaagcauucgcgaauuuucgaaagaaccaagaggaaaauaaaaagaaguucuacgccaaacagaucgcugagucagaauauaaggccaaaaaggcauuuuucgagcccuguaaaaacuuucggcagcgugucgaggaaaagauuaaggagaucuucgugaguaaaccuccaagaaagaggguccgcggcgcccuucaccaggaaacauuuuaccccuucgagaaauugugcaaugauaaggaauauagcgagaaacugaagauggacuacgguggggagaagggcaugcaaaaagcuauagcauuaggaaagauccggcagauuggcaccaaaaucguguccaacggggccaugguuagaguggauauuuuuaaggacaaaaagggaaaauucuaugcuguaccuaucuacacgauggauuuugcgcucgguauacugccaaauaaggccgucgcaauuggcaaggacaaagacggggugaucaaggauuggauugaaauggacucuaacuacgauuucuguuucucgcuuuuuaaagacgaucugaucuugguucagaagaaagagauggaaagggcugagcucugcuauuucgugagcuuuggauccaccaacgcccaaauaaaugucgagaagcauaacaauaaguucgaaggccugucagagaacgagaaaauccuauacaguaaugccacacagaaggagguggcugguaaaucuauugggauccagaaccugaagacuuuugaaaaauaucagguaagcccccucggcgaggugcaaaaggcagaguucgaaccgcaccaggagauuaagcugaaauccucaccuaagcgaaaagacuga

SEQ ID NO: 2613 - RNA, 3111 nt, Artificial Sequence
  Cas9 variant
augcugcacaagaugcauuacagacucgcccuugaccugggcagcaccuccuuggggugggcuaugaucagguuagaugcagacaaccagcccugcgccgugauuaaagcgggaguccggauauucucuaauggucgcaacccuaaggauggcucaagucuggcuguuacacgacgugaggccagagcaaugaggcggcgcagagacaggcuacucaaacggaaggcccgcaugaugcgaacucugaucgaauauggguuuuucccagcugaggcagcccaaagaaaagcucuugaaacgauuaauccguuugcccugagggcgaagggauuggaugaggcacucacccccgccgaguucggccgggcucuguuucacaucaaccagcgucgcgguuucaagagcaauagaaaaacagacaagaaagauaacgacuccggggcccugaagacugcaauuggaaaagugagggcuaccaucgaagccgagggcugucggacaguaggcgaauggcuccauaagcgagauguggcgggguuaaccguccgcgccagauaccaccaggacaaggugauaaaagaggauggaaagacuaaaaucgacaaguauuacgaucuguauauugacagggcaaugaucgaacaggaguuugacgagcuuuggaaaaagcaagcugaauugaauccugcccuguucacagaggcugcccgggcagaucuaaaagacguucuccugcaucagcgcccacuuaagcccgugaagucugguagaugcaccuuuaugccugaugaagagagggccccacuggcuuugcccucgacgcagcguuuccggauguaccaggaagucaacaaucuccgaauccugagagacggcuuaaaagaggagccucugacucucaagcaaagggaugaccuuauugcggcacuggagaaaaacucaaagcacagcuuuacccagauaaaaacauugcuaggggugggaggcgccguacaguucaauuuugaagaucugaagcgccaggaacucaaggguaacacuaccagugcuauucuguccaaugacaaacacuucgggaaggccugguucacauuugaugaggcaaaacaagacgccaucguucuucagcuggugaaggaagagaacgaggcuaaauugguccgguggcuccaggaugaaaccggaauugacgagaagagagccgaagcaaucgcgaaugugggccugccagagggcuaugggucuuuaugugcuaaggcccuggcaaggauccuaccggaacuccgccgagacgugaugacguacgauaaagccguccaagcugccggauucgagcaucacagccggcuggguuccaacacugagauucccggccuuacauuuaagauagaaucaaucgaccaggauaguggggagguuaaacaguuccauauucacaagguguugccuuacuauggagaauaccugcagcgucacguaggcuuugguagcggggagccagaggaccccgcagagaaaagauauggcaagaucgcuaacccuaccgugcauauaggacucaaucaaauuaggcuggucgugaacgcccuucugaagcgcuacggccacccaucugaaguuaucguggaauuggcgcgggaucucaaacaguccaaggaccagagagaugaggaaucaaaaaggcaggccgagaaucaaaagcgaaacaaacgccugcgggacgcuaucgcagggacuuuaaagauuagcgaggaaagagucaggcgugaugacauccagaaaaugauucugugggaggaacuaaguuucgaucccgccgaccgccggugcccguauucuggagcucagauauccgccacaaugcuccugagcgaugagguggaaguagagcauauccuuccuuuuucgcagaccuuggacgacucucugaauaacaagacgguugcacucagacaagcgaauaggauuaaggguaaccgaacccccugggaugccuucggcgcucaggccguggcaggguuugacuacgaguccauccugguccgggcugaaggaaugccaaaagccaagcgcuauagauucgcagagaauggcuaccagaggugguuaaaagaugacgccucauuucuggcucgggcgcuuaacgauacacgacacaugaguaagguggccuucgaauacuugaaacucaucuguccuaauacuagagucauucccggucgcaugaccgcaaugcugagggcuaaguuugggcuaaacgacgugcugggccucaauggagagaagaaccguaaugaucaucggcaccacgccguugacgccugcgugauagcuguaacagaucagggccugcuucaaagauucgcaaaagccagcgcguccgcuagggaacagcaguugaaccgccuggucgagaacaugccauuacccugggggucuuaucgagagcaugugcaaagagccaucaaugcaauuuggaucagccacaagccugaccauucacacgaaggagccaugcacaacgauacugcuuacggucuccggggcgacgggaaaguuaguuuccauaagaugguggagggagucaggacccacuccgaagauaaucugaaagugauugagaucagcaacgcaaaggccacagaccgccauggccuucugccaaauggugagccgcgucccuauaagggguacaaaggcgacucuaacuauuguauagaaaucguaagaaaugagaagggaaaaugggaaggcgaggugauuucaaccuuugaagcguaccaguugguucgggagcacgggaucgcuaggcuccgccauaguacucugagcgucuccggaaagcuacuggugaugcgacucaugauugaugacguggucagacugaucauagaugagcagacgcggacaaugaggauugccacccuuucuggcaacggucagaucuucauggcagacacuucggaagccaauguugaugcucgcaacagaagcaaagaggaaaccuuugccuauguguccaagauggcagggucauugcaaaaggcuaaugccaggcggauuaacaucaguccuauaggagagcugcgugacccaggcuucaaagaauga

SEQ ID NO: 2614 - RNA, 3114 nt, Artificial Sequence
  Cas9 variant
auggagagaaucuucggcuuugacauugggaccacaagcauaggauucuccgugaucgauuacucuucaacucagagugccgguaacauucaaaggcugggcguccggaucuuucccgaagcucgcgacccugaugggacgccacucaaucagcagcgacgucagaagagaaugaugaggcggcaacuucgcagaaggcggauucgccgaaaagcacugaacgagaccuugcacgaagccggauucuuaccggcguauggcagcgcugacuggcccguugugauggccgaugagccuuacgaacugagaaggcggggucuagaggaggggcucuccgcauaugaauuuggacgugccaucuaccaucuggcucagcaccgccauuucaagggcagagagcuugaagagucugacacaccagaucccgacguagaugacgagaaagaagcagccaaugagagggcugccacucugaaggcguugaaaaacgaacagaccacacucggcgcauggcuggcccggcgaccuccaucggaucgcaagagagggauacacgcucauaggaauguggucgccgaggaauuugagcggcugugggaggugcagucaaaguuccaccccgcacucaaaagcgaagagaugcgcgcuagaaucagugacaccauuuuugcccaaaggccuguuuucuggcguaagaacacuuuaggagaaugccgguuuaugccaggugagccgcugugucccaaaggcuccuggcuuucucagcagcgaagaauguuggaaaagcugaauaaccuagcgaucgccgggggaaaugcaaggccucucgaugcugaggagcgcgacgccauucugagcaaacuucagcaacaggcuuccaugucauggccaggcgugcggagugcccugaaggcauuguauaagcagagaggugaacccggggccgagaaaagccucaaguucaaccuggaauuaggaggcgagucuaaacugcucggcaaugcucuugaagcgaagcuggcagacauguuugggccugauuggccagcccaccccaggaaacaagagauccgccaugcuguccacgagcgauugugggccgcagacuacggagaaacaccggauaagaaacgggugauaauucuauccgagaaggaccguaaggcccauagagaagcugccgcaaacucauucguagcggauuucgguaucaccggcgagcaggcugcccagcugcaggcacucaaacugccuacggggugggagcccuauagcauuccagcccuuaaucuguuuuuggcugaacucgagaagggagaaagguucggcgcccugguuaacgguccugacugggagggguggcgccggacuaauuuuccccacagaaaccaaccaaccggcgaaaucuuagauaaacugcccaguccugcaucuaaggaggagagggaacgaaucucccagcuacgcaacccaacagugguccggacucagaaugagcucagaaaaguggugaacaaucugauuggacuuuacggcaagccggacaggauacguaucgaagucgggcgcgauguuggaaagagcaaacgggagagagaagagauucagucggguaucaggcgaaacgagaagcaacggaaaaaggcuaccgaagacuugauuaaaaauggcauagccaaccccucucgcgaugacguggagaaguggauccuguggaaggaagggcaggagagaugcccuuacacaggagaccagaucggcuucaaugcgcucuuuagggaaggucgguaugagguagagcacauuuggccacgauccagaucauucgauaacaguccccgcaauaaaacccuguguaggaaggacgugaacaucgaaaaagggaaucguaugccuuuugaggccuucggccaugaugaagaccgguggagcgcuauucagauaagacuucaaggaauggucuccgcaaagggcgggacgggaaugucuccagguaaagugaagagguuucuggccaagacuaugcccgaggauuucgcugcccgccaguugaacgacacacgauacgcagcgaaacagauccucgcccagcugaagagauuauggccggauaugggcccugaggcuccaguuaaaguggaagccgucaccgggcaagugacugcacagcugcggaagcuauggacacucaauaacauucuggcugacgauggagagaaaaccagggccgaccaccgccaucacgcaaucgaugcccuuacgguagcuugcacccaucccggcaugacaaauaaguugagccguuauuggcagcugagagacgauccucgggcggaaaaacccgcccucacuccaccuugggacaccaucagggcagacgcugagaaggccguuucagaaauuguggucagucaccgcgugcgaaagaaagucuccgguccccugcacaaggagacaacuuacggggauaccggcacagacauaaaaaccaagagcggaacuuauagacaauuugugacgcggaaaaagaucgagucuuuaucaaagggcgaacuggaugagauuagggacccacgcaucaaagaaauuguugccgcucauguggcagggagaggaggcgauccgaagaaagccuucccucccuacccauguguaagucccggugggccugagaucaggaagguccggcuuacaagcaaacagcaguugaaccucauggcgcagaccggaaacggcuaugcugaccuggguuccaaucaccauauagccaucuaccgucuaccagauggcaaggcagacuuugaaauugugucucuguucgaugccucgcgccgacucgcucaaagaaaccccaucguucagaggacucgggcagacggggccagcuucgugaugucccuggcggcuggagaggccauuaugaucccugagggcucaaagaaagggauauggauuguccagggagugugggcaaguggccagguagugcuugaacgcgauaccgacgccgaucacucuacaaccacuagaccgaugccaaaucccaucuugaaggacgacgcuaaaaagguuagcauugauccuaucgguaggguccggccauccaacgacuga

SEQ ID NO: 2615 - RNA, 3117 nt, Artificial Sequence
  Cas9 variant
auggccaaacaggugagauacaggcugagccucgaccuuggcuccaccucucuggggugggcuaucuuccgguuggaugcagacgcccaccccacagcgauuauaaaggcuggaguccgcaucuuuucagauggucgaaacgccaaggacggcaguagcuuagcaguuacucguagagccgcuagguccaugcggcgcagaagggaucggcugcuacgccgaaaaacgagaaugcucgacgcacugcuugaguauggguucuuuccucaagaugccgcucagaggaaggcccuggaacgguugaauccauacgcgcuccgugcagagggacuggcccgcccgcugacccccggcgaguucgcuagagccauuuuucaucucaaccagaggcgggguuucaaaucuaaucgaaagacagacaagaacgauaaugacucgggggcauuaaaaacugcuaccucacagcugcgccaagauauccaggccagcggaugcagaacagugggcgaguggcuuuggacccagagguugcagaagaaaccugaaggcguaccacaccaaggggugcgggcgcgcuauagagagacuccccauauuaacagugagggaaagaaaaggaucgaaaagaaguacgaccuguauauagaucguuccaugaucgaggccgaauuugacgcacuauggucugcucaggccacauucaauccugucguguuucacgcuaccgcccaugagaaacucaaggacauucugcuuuaccagcggccacugcgacccguuaaaccugguagauguacguugcucccagaggaagagagggcaccgcuggccuuacccagcacucagcgcuuccggaucuaucaagaacugaacaaucucagacuucugguggaucaguugaacgagcagccucuaacccuggcucaaagggacacaauugcgacucucauggaaggccgcgcaaagaucuccuuugaucagauacgaaaagcccugaaguuagggucaaugaccaaauucaaucuggaggacgauaagcggaacgaguugaagggaaaugcuacaggcagucagcucgccaaaaaggaauuuuucgguccagcauggcaccaguucgacgaggcccugcaagaugacauugucuggcacuuacugagcgaagagaacgaaucugcucuaaucuccuggcuccaggaucguaccgggauugacgccgcaacggcgcaggcugugucaaaugccagccugcccgagggauacggcagucuuucuagaaaagcauuggagguaauccugccuaggcuccgcuccgaaguuaucacuuacgauaaggccgugcaggcugccggcuuuagccaucacucgcaacugggguucgaguaugacccagacgaugucgaagacuggauugaucaugcaacaggagaggugaaacccauauuuaagcggcuuccguacuaugguaaggcucugcagagacacguggccuucggcucugggaaaccugaagacucccaggagaagagguacggaaaaaucgcgaaccccaccguccacauuggcuugaaccagguucgagugguagccaaugcucucaucgcacgcuauggucggccaacugagauaauuaucgaacuggccagagauuuaaagcaaucaagggagcagcgucagcaggaccaacgccggcaggcugauaaccagaaaagaaaugccaggauccgaaacaguauugcacaagcgcuggggaucgccgaagcucgggugcgcagagaggacauucagaaguggauacuaugggaggaacucgauccuggcgacgccaugcauaggugcugucccuacagcggagucccaaucuccgcaucuaugcugcuuagcgaacagguggaaauugagcacaucuugcccuuuucaaugacacuggaugacagucucaauaaccggaccguuucccugcgacaggcuaauagaaucaagcgcaacaggagcccuugggaugcccgugaagacuucgaggcacaaggcuggcauuaugacgggauuuuacagcgggccggacugaugccagugcagaaaagauacagguuugcugcggaugguuaccagcgcuggcuucgagacgaucaagacuucuuggccagagcacucaaugauacgcgguaucugucuaggauagcugccgaguaccuacgccuggucugcccgcagggcacccgugugauccccgggcagcucacagcccugcuuagacggagguuuggauugaacgacauucugggcuuagaaggugagaagaaucgcaacgaucaccgacaucacgcuguagacgcauguguuaucgggauuacugaucacggccucaugcagagauucgcccgggcgucagcucaagccagggaacagggacugacccgccuugcagaggaaaugccucugccauggcccacauauagagaccauguggauagggccgucaguuugaucugggugagccacaaaccugaccauggccacgagggggcuaugauggaggaaacugcauacggacucaugaaggaugguaccauacggcagcgucacaaagccgacggcacaaaggggcgcgaggucgcgaaugugauccgaauugcugaaccagcccaacccaccagacauggaguugacgaucagggcaggccgcugccuuauaaggguuacaucgggggcuccaacuauugcauugagaucacucggggagcacagggcaaaugggaagggacggugauaucuacaucggacgccuacggaauuguacgcgcuagaggcaucgccggucuaaggaauaccagccaggggcaaaacggacacccacuggucaugcggcucgugauuggcgauucccugcgacuuagaaucaacgacgcauugcagacuaugcgcguuaccaagauaucagguaauggccagguguuuauggcugggguccaugaggccaacguggaugcgaggaaucgggacaaaagucaggccuucgcacugguaucuaagauggcuggaagccuucaagccgcucaggcacgucaggccacaaucucccccauuggcgagaucagagauccuggguuucccggauga

SEQ ID NO: 2616 - RNA, 3120 nt, Artificial Sequence
  Cas9 variant
augaagaaaagaauccugggccucgacauugggauagccagcgugggaugggcucuuaucgaguucgaugacgaauuucaggauaacaagaaaaaggguaccauuaucaaauccggcgucaggauuuucacacgggcagagacucccaaggaacgcgagccucuggccaagccacgacgugaagcgagaucucaaaggcggcgcaucucaugcagaguugagagguugaauuuugugcgggaguuauucgugaaaaacgggcugguagcuaaggaaagugucaauaaaaacaauccgaacaauauauacaucacgcuaaaccagauuaagacccccuggcagcuccgcauggaggcccuggaccgaaaacuuacaaaugaagaguuugcagugguucugacucacuuggccaagcauagaggauauaagagccucaggaaaaccgauuccaaggacaacaaaacaggcgagaugcugaaggcuaucaaucagaacaaagaacggcuggauaauucugacuaccguacccucggugagauguucuguaagcacgaaucguauaaagagcauaagcgcaacaaggauggggaauacauuaauucagugacuagagaguuaaucgaggaagaggcagagaaaauauuugccaagcaaaggaaagaaggaaacaacuucgcugacgucgauauugaacgggaguaucugaagaucgccuuuagccagaaaccuacaggcaguauuaauaagauggugggcuucugcaccuuugagaacggggaaaagcgagcgccacgcgacuccuacucugcagagcuuuucaaaguauugaauacgaucaacaauacuaccaucacagauaugaagacuggagaaaccagaaacuuuacaggugccgagauuaaaaagauaaucgaaauuaucaaagacaccaagggcauaacguauguuaagauuaaaaaggagcugaaacuagggagcucccaguucucaggaguggacuacagggagaaugcuaagaguaaaggcgaaggugagaucuucgucagcaugaagacuuaccacgaaaucaagucuaaaauugagaagcucuccaaagagaaguggaacaaacugaaggaaaauacagagcuucuggauucaaucgugaacauuauagccaauuuuaaagacgaugaaagcaucaagaaggaguuccagaaauugaagauugacgaagauaucaucgacgugcuccugaacuuugaguucaaaaaguuuauuaauuuaaguuucaaagcacugcggaagauaauccccuuucaauuccaggggcagaaguauauuaccgcuucuauguccgucggauacagccucaaacaggagggcaucaagaacaaauuucuucgcguuccuucgcaagaagagaaugugaacguaccaguggucgccagagcguucgcccagacuaggaaggugauuaacgcaguuauccgugaauauggccaguuugaucaaauaaauaucgagcuggcuacagacuugaaaaacucuaaguucgaucgguccaagauugaaaaagggcagaaggaguuucagucacagaaagacaagguguuccaagagguccaggaucuaaccggagaaaucauucccaguagcucccugcuccugaaauaccgacuuuggagagagcaggacgaaagguguaucuauucuggucgcaagauaagccggaaggaccuguuggauacgggcuuccucgacauugaucauaucauuccuuacucaaaaaguauggacgauggguuuaauaacaaggugcugugcuuagccgaggaaaauagaaacaaaaagaaugacaucccauucaacuauuaccagaggauaggacgcgauuggaauuuucugaucuccauuaucgcuagcaugaaaaacaugaaguacguuaaaaagaagcgacuacucaaacaagagcugucugacauugagaucgaaucauucauagagcggaauauuaacgauacccguuaugccacaagauacaucaagaauuuucuugaaaacaauuuggaguucaaagagaacgaauuuaucaaggcaaaaguacaggccaggcacggcggucugaccagugugcuccgcuauaacugggggauuagcaagaaucgggaggaauccuaccugcaccaugcuaaggacgcgaucacugucgcauguucuacacagggcauggugcaguauauuucgaacauaagccaaaaauacgagaauggaaaguauaaaaugaagcagaucaaagaaagaacugagaacaggauuccgaagcccugggauuccuucaaggacgaugucgagcgaucaaucaaugacauuuuugugaguuucgccccucgccacaaaguuaccggcucugcucauaaggaaacaaucuacagcaaaaagcaccuugagaaaggguacgugaccauaaagaagucccuggacaaaaucaaguugucagaucucaaaaacauuccaugcgacgaaaauugugauaucauucggguacugaaggagagauuagaaaaauuuaacgacgauagccugaaggccuucgcagaccccguccacaugccuacuaagugcucuaauaaaaagggaccaaucauaagguccgugaaaauuaaggagaacaauaaaacggguaucgagguucguaagggccuaguggaacgcggggauaugguccggguggacguauuuaucaaagauaagaaguauuaccucgugcccauuuauguuagugacuucaaaaacaaggaucugccgaauaaagccauagucagcucuaaguccgagaacgaauggaucaugauugacaaaacauacucauucaaguuuagucuuuucaaggaugacuugaucaaaauuaagaauaaaaagggagagaucuuuggcuaucuggguggggugcauagacucaccggcggaauaaacaucaaaagcuguuacaagccuaaggaaaaagacggcaacauugggucgaagugccuguuagauuucaggaaauuucaggugggaauccugggugacuauaaugaggucaagcacgagaaacgaaugcccgcuuacauuaacacuaagaaggauaaagaacauuga

SEQ ID NO: 2617 - RNA, 3123 nt, Artificial Sequence
  Cas9 variant
auggacagaagggaugcccgggcuaugcgccgacguagagacagguuccagcaacggcagcgcgcacugcucaaguaccuuguggccgauggccuguuucccgaggacgaaggggagagaaaagcguuggcugccuuagauccuuaugcacugagggcccgggcucuagacgaagcacucagccugcacgagcuuggacgcgcccuguuccauuugaaccagcgaagagguuuuaaguccaauaggaaagcugaucggaaggccgacgaugacgcgggcaaaaucgcaauuggggucgaucgugcccgcgaagcuauggccgagaacggagcaagaaccuacggcgaguggcuccacaggcggcgagcuucugccacagacgcgaaugccauaccaccgguucgcacuagacugaggcccgaaucaggugaggaugcaaagggggacggauaugacuucuacccuggccgggaucugcucgaagaggaguuugcugccaucugggaagcucaggccgcacaucacccagacguguuaacggaugacguauaugagcgccuguucgaaauuguguuuuaccaaagaccccuuaaggccccucagaucggcaugugcaccuugauugcuggggauaggcgucugccaaaagcgcauccccuauuccagcggcgaagacuccuggaggaacuuaacgcacugaugaucgucaggccuggagagguggcccagcgcuugacacgggaggaaagagacacucucuuucugaaguuaaaagauaggaauaagguuaguuucgagagccugcgcaaaacccucaagcuagacccagaugcucgauuuaacaaggaauccgagaaucggacagaacugaaaggugacgagguggccgcagccaugggcucuaagacccguuucgggaacagauggguccacuugucgauagaggaacaaugggcugugaucgagaggcuaggagauguagaaucagacgccgaggacgcagcguuucgcgcuuggcuggccgaacgguaugagcucacuccggagcagacaagagcaguuaccaaugcuccccugccucagggcuacgguagguucggggaaacggcuacucgaaaacuuauugaugcccugcgcgacggagagaaggauggccggguguuggucuacagcgaagcagugaccgcugccggccucgggcaccauagugacagaaggacaggagagguguucgaggaugaagagggucguccacagcugcccuauuacggcgucgcguuagaacgccacaucaugccugggacuggagacccauccgauucugacgagaugcggguuggcagacugaccaaccccacagugcauauuggucuaaaucaacucaggcgaaucguaaaccggcugauacgcgccuaugggccgccugcugaaauugcaaucgagcuugccagagaguugaaacugaccgaugaagacaagaaaaggauuaauaaggagaacaauagcaaccggcucgaugcugaacgaagauccgagaagcugcuugccaucggcaaacccgacacgggagcaaaccgcgcgcuguugaagcucugggaggaacugaauccagccaacguguuagauaggcguuguaucuacucaggcguccagauuaguauagacaugcuguuuagcgcugccguggagguugaccacauccuaccuuucacugcaacacucgaugacucuaaugggaacaaaauugugugcacccgggaagcuaauagagagaagaggaaacgcucccccuaugaagccuggggacacucagcacgaugggaggaaaucgccgcuagagcggcccagcugccacggaacaagagguggcgcuuugagcccgaugcaauggagaaguucaaagacgaugguggcuuucaagcucgucaucuuauagacacucaguacuuggccagacugagccgggaauaucucgccacacuguacccugauaagggggagggaaguggccacauuugggucucuccagguagguuaaccgaaauggugcgccgaaaacuggggcuuaaugacuugcucccggaucauaacuucggcggaggcgcugaccaggcaaagaauagacuggaucaccggcaucacgccaucgacgcgguaguuguggcuaucgucgauagggggaugcuaaaccgcauugccagagcauccggacaggagggugccgagggcagggaacggaucauuauacccgagccuugggaaggguuucgugacgaccugcgcacggcugugaaugcaaucaccgucagccaccgaacagaucauggaacugccucgaaagcgggccucccaaaggguaaggacgcuaccgccgggagacugcacaacgauacagcauacggcuucacuggagagucugacgccaaaggcaauuccauugugguuaggcgggugccccuuucaaguuuuaagaaauuggcugauaucgaccgcguaagagauccugaacugaaggccgcauuauaucaacaucucgacgggcuggagggaaaagccuucgagaaggccaucggcgaauuugguagcagggaguggcacccauacgggggaguccggcgagugagaguuaccgaaccccuuuccgugauuccgauacgcgauaggaacggccacaucuauaaggguuacaaaggcgacucuaauuaucgguacgaugucugggagcugccugggggaaagugggugaacgaaguagugagcauguucgacgcgcaucagccaggcuggcagucagccauucgugcagcuaaccccacagccagaaaaguuuugagucuccacagggacgauguccuggcuaucgagcgcaauggggcagagcgggaacuugugcgaguggucaaguuuuccgagaaacaguucgccguugccccucccaacgaaggaggcgcucugaaggcgagagacgcagauaaaggugacccauucaaguauagcuacccuucucccaauacccucaaggcccugagggcucgccaagugcggauugaugagcuugggagaguguuggacccaggauuuccggcccguacuaaacagaggaagacgcggaaaccuaacuga

SEQ ID NO: 2618 - RNA, 3132 nt, Artificial Sequence
  Cas9 variant
augcagagagacaacccccugguguacaggcucgcccuugaucugggcagcaccuccuuggggugggcugucuuccgguuagacgcagagggaucuccucuggccaucauuaaggcgggugcucgcauauuuucagauggccgaaauccaaaagacgggaguagccuagccguuacacguagagcagccagggcuaugcggcgcagaagggaucggcuccugaagcgcaaagcacgaaugcuuggagcccuggaaagacacggcuucuuuccgcaagacgaguccgcuaggaagguguuggaaacucucaaccccuuccugcugcgggcccagggucucgagguagcguuaaaaccugaagaguuugggcgugcacuguuccaucuuaaucagcgcagaggauuucagucuaacaggaagacggaucggaaggacucggauucaggcgccuugaaacaagcuaucggcacccugcgagcccagaugcacgagagcgggugccgcacagugggagaaugguucuggaaggucagaauggagcauaaaccagaaggugugaagggccaggggguuagggcacgguaucgcgagacucccuuuaccacagacgaggggaaaaagagaauugauaagagguacgaccuauauguggaucgugcuauggucgcccaggaguucgacgcgcucugggccgcacaagcugccuuuaauccugcucuguucaacgaagccgcacgggccgaacuucgagacauccuguugcaccagagaaaacucaggccagugcagcccggccgcuguacccugguaccugaggaaccacgggcuuuacuggcgcucaguuccacucagagauuuaggauuuaccaagagguuaaucaucuucgcgugcugcacgaugaguugcgagaagagacacuaacccuggcacagcgggaccagaucgucgcccuccuggaaaagcaagcuaaagugacguucacugccaugcguaaggcacuugguuucucugcccuguuuaacuuggaggaugcuaaaagagacgggcucaagggaaaugccaccgcagcggcucugagcaaaaaggauuuauucggcccgcugugggccggcuuugggacagcacuacaggacgaaauagugacucagcucaugaccgaggaguccgaacccaggcugaucgccuggcuucaggagcacacaggagucgaugaagcucgcgcccaagcaauugcuaacaccgguuugccugagggcuaugggucacugggacggacggcccucgcgagaaucguuccagaacugcagagggacgugauuacuuacgauaaggccguacaggcugcaggcuucgcccaucacagugaccuugguuuuagcuucgagcauggggcugaugagguggaacgaaucggcgagcgcacaauagccucuaccggagaaauuaaacccgucuuugcauucaagcagcugccuuauuacggccgggcguugcaaagacacguggccuuugcuaaagacaauccaaggaacgacgaggagcguuacgggaagaucgccaaucccacuguucacauuggacucaaccaggugcgcgucgugguaaaugcacugaugcggagauaugguaggccggcugaaguugugaucgaguuagcccgagaucugaaacagucccgggaacagaagcuagaggcacaacagcgccaggccgacaaccagaagagaaacgcuaggauccggcgaucaauugcggaaguccucggcauaagcgaggagagagugcgcacacuggauauccaaaaauggauucuuugggaagaguugagucaugacgccgcagauaggcguugcccuuacucugggguccagaucuccgcuagcaugcugcucggagaacggguggagauagaacacauucugcccuucucgaugaccuuagacgauucucugaauaacagaacgguugcccuuagggaggccaaucgcaucaagcgaaacagagcuccaugggaggcacgggccgacuuugaagcgcagggcugguccuaugaugguaucuugcaaagggcugagcgcaugccucuccguaaaagauaccgguucgcccccgacggguaugaaagguggcugggcgaggauaaggacuuucuagcacgcgcccugaaugauacccgauaccucucaagaguggcugcagaauaucugcggcuuguauguccaggaagugccacaagggucauucccggccagaugacugcguugcugcgcgggaaauucggauuaaacgacgugcucggucuggacggcgagaagaauagaaacgaucauaggcaccaugcuguugacgccugcgugaucggggucaccgaucagcggaugaugcagcguuucgcacaagccaaugcucaggcccgcgaggacggacuuacacgacugguggaagauaugccuuugccauggccgacuuacagagaccacguagagagggcagugcaccauauuuggguuagccacaagcccgaucauggcuuugaaggugcuaugauggaggagaccuccuacgggauacuccgggacggcucuaucaaacagcgcagaaaggccgauggaagcgcgggcagggaaauuucaaaccugauccggaucgccgagccugggcagccacaacgacacggagucgacgcagaaggcagaccccuaccuuauaaagguuacgugggaggaaguaauuauuguauugagauaacagugaacgauaagggcaaaugggaaggucaggucaucuccaccuucgacgcuuaccgcauuguuagggagggcgggcugcggcagcuccgucacccaacucagggacaaaauggcagagcccuggcuaugaggcuugugaucggggauagcgugcgcuuggaggcaggagaaggcucucugcagacguuacggguagccaagaugucagccgcuggucaggucuuuaugagugaggugaaccaagcgaauguugacgcacgaaacagaaacggggaccuccccuaugugagcaagauggccggauccuuccagaaagcuagggcccgccaggucacaauuucuccgaucggcgaacugcgggauccugguuuuaagggcuga

SEQ ID NO: 2619 - RNA, 3135 nt, Artificial Sequence
  Cas9 variant
augaaguacacccugggccucgaccuuggguauaacagcaucggaugggccauucuggagaaugaugaaaacgguucccccauaaaauuguucaaugcuggcgugcacaucuuugagccuucuauugaagacaucgagauugaugggaagggaaaaacaaagaacgucaaaagaagggaagcacgguuacgccgacgucagcuguucagaaagacuaagaggcuagagaaacuccugaacuuuuucauccaagagggcuuuuuccagaaucagaagguucuuauaaaugacccauuugaacgggccgaguuccuguaccaguuggauaaaaagucacgcaacccguauauccucagaagggaagcgcuggacaaucggcugagucucgaggagauugcucgcaucuuuuaccauauugcccaacaccgagguuucaaaagcacgaagagagaauuagcagagaugaacaaggaugaaaagaagaaaaaggaggacgggaucauacaguccgaaauuaauacccugaaagaggagaucaagaaaaacucuugcaggacacuuggagaauauuuugccaaguuguucgagaauggcgaaaagauucggggccgucauacugaucgcaaaauguacgaggaagaguuucagaagaucuucaacaaacagaaggaguucuaucccaauaucuuuaccgacgaguucaaaaagaagcuguacaaacuaauuuuucaccaaagagagcucaagucgcagaaagauaaggugggguucuguucacuggaaagggguaaaaagcgggcuccucuugcacuguugguaagccagcgauaccgcuauaugugcaaggugaacaaccucaaugucauagacacagagaccggagaaaacagagagcugacuguggaugagaaaaagaaauuauacgaaaagcuggagaauagugaaaaacucuccuuuaaggagaucaagaaaauucuuaaccugucugagaagagguauaucuucaauuuggagaaaagcgaaaaguacauaauuggcaacaaaacaaauguuaagaugaaaaacaucaucaaggacugggacaauuuugaugaagacaagaaaaacuucuuuauuaaugaggcccggaccguggucaagaucgaaacgcuagagcgcagagggaaaaagcugggacucuccgaugaggaaucaaaagaguucaguaaggugguauuugaagacggcuaucugaacuucagcaagaaagcuguugagaaacuucugccauacuugaaagaagguaagaaagaguaugaggccauuaagcucgcguaccccgaaaauucugugcagaacgauaaucugaaggaguuagacuuucugccuccaauaaaauccaaggaacucaaaaaguacuucgaggucaggaaccccaucguggaaaaagcacuaacugagacccguuaucuggugaacuuccuuauuaagaaguacgggaaaccugagacaaucaagaucgaauuggcccgggagcugaaacucucaaauaagcaaaaagaacgaaagcauaaagagaaccaggagaauagaaagaagagggaagaggucauugaaaaacugaagaacgaucuuaaaauaagcgagccaacugaaacccagauccaaaaguaucuguuggcugaggagugugacugcaaauguccguacacaggacgcaguauuucuauggauucccucuuuggcgaacacccccuguucgacaucgagcacauuaucccuuuugaucggagcuuagacaauucguuccugaacaagacccuaugcuauucugaagagaauagaaagguuaaacauaacaagacgccauacgaagccuauuacggcacugagaaaugggaggcaauaaucgaaagggugaagaaauuuaaguccaauguacgcaacgagaagcuccgacgguuccagaugacaaaagaagacguggagaauuacauucagaacuuuucaacccagaaucugaacgauacuaaguaugcuaguaaacuugccaagaaauacuuggggcugcucuauggaagcaucaaugaagacgguauugauaagaaccguaagagaaggaucuucgcguccucuggcaaagucacaagcacccugcgcuacgccuuagggcugaacacgauacuuaaugacgagaacauuaagacccgggaggaucacagacaucacgcaaucgacgcuauuacaaucgccuugacugauucaaguaugaucaaaaagauauccgacgcuagcaaaagggaaaagaauauuaacucucucuuuaaggauuuccaagcccccugggagaauuuucgaaaagaaguggaggagaucauugcaaagaugaacaucucaauacgcauuaauaaaaagguuaguggacagauccacgacgaaaccuucuauaaaaagccuuuuaaagaggaagaaaagagcuacacacaucagcggaucaaccuggaggaacuaacuauuaaggaugaggacaaaaagaaacaguccucuaagcugaucgauaauauuguggacucgaaaauaagaaacaucauuaucaauagccucaacggcgaaaagccaaagauuagguucaaagaccccaaggaucacccguauaucauacagaaaaaugguaagaaaauccaaauucauaaggucaccaucaagacaaaacuggagaccuacaacgaaauugggccugagaaggccaaacguuacgugaaguccucagacagucaccauaucgaaauauucgaggaucuuaaaacuaagaagugggacggcuauguaguuucuuugcuggaggcuuacgaacgcaaaaagaaaaaguuacccauugugaauaaaaaccucggagagggcaagaaauuucuguucagccuugcgaagggggaaaucaucgagcuggauacggaaaacggaaagcgggaguuguuugucgugagaauuauauccgcaucaaauaaccagaucaaauucacaaggauuaaugacagccgaaagaucaccgauauuccagccacuggucucaccgcuuguccuucuucccugaaaaagcggaacugcaaaaaggucgugaucaauauacuaggcgagaagcacuauaguaacgacuga

SEQ ID NO: 2620 - RNA, 3135 nt, Artificial Sequence
  Cas9 variant
auggccgagaagaaauucaaguacagacugggccucgaccuugggaccaacagcaucggauggugcaugcugagguugaauaaagauaacgaacccgcugcagugauuaaguccgguguccggauauuucacgacggccgcaaugagaaaacaaaggaaccuuuagccguugugcgacguaacgcgagaucuaucaggcggaaucuggaucgcaagauuucaagaaggaaccaucuacucaauacucugguaaaauauuuccuucugccaaguaacgagaucgaacggaaggcuuuggccgugcucaauccguacgagcugcgcagccgagcagucaacgagagacuggaacucuuugaguuagggaggcugcuuaugcacuuguccaaacggcguggauucaagucuaaucgcaaaguggacaaggaagauucgucaggcaagauuaaacccgccaucgagagacugaagaacaaaaugcaggagacgaauaagaaaaccgcuggugaauaucuauacagccucaugcaaaacgggaagccuguuagggcacggcugggacgaauagacggcaguaauggcuaugagaucuaccuugaucgcgcccugauugaagaggaauauaacuugaucaugaacgagcagaaaaagcaucacaaggagcucacagacgauauuaucaaugaaauauuuaacauuaucuucuaccagagaccacugaaaaagcagauuaucgggaaauguuccuuaacuggagaggacaccaagcugaaaaaggcucaugugcucgcccaagauuuuauccuucugcagaagguccaggacuugaggguguucgaugacaaucagcuagaauuucggccccugucuaacgacgagaaagauauuauaaagcgcgaacucaggaaaaagaaagagguaagcuacgagaauaucagaaagcugcuuaagaaauauuacgaaaacguuaaguaugguauguucucccacgagacacuguacaaaaaguugcaaggcaauaaaaccaacgcgcucaugucagacaaggaaauuaucggggauaguugguauagccugucuccugaggugcaguacgacauaauugaagaguuauauuccgauaaggacaaugaugagcugucaaaacuauacagcgaaaaguuuaaccucaaugagagucagaucaacggacugcuuaauaaagcaaucuaccguuuggacucuggcuauauucgguacgguaagacugccgucacaaaccucaauuccaucauggauaaagacaaccugaaccugcacgaugcucgagaagaggccggguaugagaaggaaaauaaacaggacgcaagcgaguaccuugaauauuacggaaaggugcugccagacucgguggucgauccccaaauugagaacccuaagaaugacgaagagagauauggcaaaauagcuaacccaaccguucaugccgcguugaaucagcucaggaagcuggugaacgaguuaaucaaacuguacggcaagccggaacagauuguaaucgagcuagcccgcgaucucaaaaauucucggaaggcaaaggacgugaucaacaaaaagauugcugaaaauagaaaacugaacgaggaagucgauaagacgcuucaagaguacuccgagaaauauaauacucacauagugaagaacaaguugaauagggacaaaguuaagcuguggcgcgaacucgggaaagauccccuggagcgaaagugcaucuacaccggagaacagauuaacaucgccaaauuauucucagacgaggugcagauugaacauaucgucccuuauaguaagacacuggaugacagcuuuaauaacaagacucuuuccaugaaacaggcuaacuacuauaaggguaauaaaaccccauacgaggccuucaaggauucuaaagacggcuauaacuacgaugacauaaucgcacgggccaaguugcucaauaacgacaauaaauucaagcguuuuacaaaggaugcuauggacauuuacaacagagaugggaaagacuucaucgcgaggcaacugagcgauacccaguaucuaucaacgcgcgcacugauuuaccuccagagucuguaugagaaggcccaccacuccagcaucuggacuauacccggacagcuuacagcuuugauucggaauuaccugggcuuaaacacccucaucucuaaugacaaaaacaagaauagaaacgaucauaggcaccaugccguggacgcauuuguaguugccgugacuucacgaagucugcuucagaaaauuagcuaugcugccucccugcaagaagauuuggacaaucgcaacgucucuucguaccggaauaagcuccuggagaagaugccugaaccauuccccaacuauagaaaaagccuagagcuggcaaucgauaacauaaagacaucccacaaagcggacaggucaaucagugguaagcuccaugaggauaccgcuuacgggauuguggaaaaugacgacaaauacaacgucgugacgcguuggaccguugauaaguuuaaggagcagaaacacuucgaaacaauccgcgacaaugagcugaaggaaauugccuguucugauaaagagcuuuuugcaaagaucguggagacucggaaaauaaagagcauuagaaaguuggccaaagaaaacccgguaaucaagaucaaagacaaguccggcagggauuauaaggcuuucgccggaggcaauaacauuugcgucgagaucuacgaaguggacgggguucgaaagucagaggugauucagcuguuugaugcagcucaaaagggauucaugccugaauggaugaaaaaguaucccaaugguaaauuacucaugcggcuguuuaagggcgacgucauaggguucaucgagaaccgcaaauacaauuauuacaccauuaagggaaucagcauugccgaucagaaccuuaaacugcuagcgaucaauaaggccgagggcauauuuaagaaaggucucaacauccuguucgacucuaauaacaaaaauuccuugaacgcuaaacaguucaauauuagugugacagggaucguaacuaagaaaaagaccgcagaugugaacuuuuggaagaacagaaaauga

SEQ ID NO: 2621 - RNA, 3135 nt, Artificial Sequence
  Cas9 variant
augcugcacaagaugagauacaggcucgcccuugaccugggcagcaccuccuuggggugggcuauggugcgguuaaacgcaaaucagcaacccugcgccgucaucaaagcgggaguucgcauuuucucuaacggucgaaauccuaaggauggcucaagucuggcugugacacguagagaggccaggagcaugcggcgcagaagggaccggcuacucaaacgcaaggcacgaaugaugagaacucugauagaauauggguuuuucccagccaacgagacgcagaggaaagcucuugaaaaucugaacccguacgcauugcgggccaagggacucgaugaggcucugacccccuccgaauuugcccgugcgcuguuccauaucaaucagcgcagaggcuuuaagucuaacaggaaaacagacaagaaagauucggacucaggugcacucaagacugccauuaaacaguuacacagcguacuggauccucaagggaaugacggaaagccacggaccgugggcgagcuuuuguauaagcgauucacagaucugaguaaacuacccaaggaccgcaccgucagagcuagguaccggcaggauaaaaucgugaaggacgauggcaaaacuaagauugacaaauauuacgaccucuauaucgaucgcgccaugauagagcaggaauuugacgcacuguggaagaagcaguccgagcuuaacccuauccuguucacagaaaaugcuagagccgauuugaaagacguucuccuguaccaaaggucuuuaaagccagugaaacccgggcguuguaccuuuaugagcgaggaggaacgggcgccucuggcccucccauccacgcagcgauucagaauguaccaggaggucaacaaucuuaggauucugcgcgaaggauugaaggaggaaucacuaacucugcagcaacgggaugaccucaucaacgcacuggagaaaaauaacagaaggaccuuuacacagauuaagaagcugcugggugugggcgggaguguacaguucaacuuugaggauccgaaacgcgaagaguugaagggaaauacuaccagcgcuauccucggcaaaucugaacauuucggugaggccugguucgcuuuuaacgaagccaagcaagacgcaauaguucugcaguuaauuaaagaggagaaugaagccaagcuggugcgauggcuacaggaugagacagggaucgacgaaaagcgggcugaggucauugcgaacgcaggacuccccgaaggcuauggcucccugugcaucgaggcccuugcucguaucuugccugagcugagaagggauguggugaccuacgacaaagccguccaggcagccggguucgaacaccauucaaagcucaaucgcaacgaggaaauuccagacauaacguuuaaaaucgagagcauugaucggaauaguggagagaucaagcaauuccaccuucacaaagaacuucccuauuacggugaguaucugcagagacauguuggcuuugggucuggaaagccugaagacuccauagagaagagguacggcaaaauugcuaacccaacugugcacaucgguuugaaucagguacgaguggucgugaacgcccucaucaagcgcuaugggcaucccagcgaaauuaucguugagguggcacgggaucugaaacagucgaaggacagaagggaugaggaaaauaaacgucaagcggagaaccagaagcgcaaugaacgguuaagaaaagacauugcugauauacugggcaucucugaggaaaggguccgacgggacgauauugagaagaugauccuaugggaggaacucuccuucgacccggccgaucgcagauguccuuacucaggagugcagguaaguacaguuaugcugcuuagcgacgagguggaagucgagcacaucuugcccuuuucccagacccuggaugacucucucaacaauaagacuguggcacugaggcaagccaaccggauuaaaggcaaccgaacaccaugggaggcuuucgggaccagcaauauaucaggauuugacuacagugguaucuuaacgagagccgaacugaugccuaaggcaaaacgcuauagguucgcugaggauggcuaccagcguuggcuuaaggacgaugccggguuuuuggcgcgggcccucaacgacaccagacaccuguccaaaauugcuagggaauauaugagccuaaucugccccaauacacgcgucauuccaggacagaugacugcaaugcugcgaagaaacuucggccucaaugaugugcugggucuuaacggggagaagaaucggaacgaccauaggcaccaugccguugaugcuugugugaucgccguaaccgaccagggcuugcugcaacgcuuugcagcggccucugcuucagcccgugaaagacaguuaaaucggcucgucgagaacaugccccugccuugggagaguuacagggaacacgugcgccgagcaauagauggaaucuggguuagccauagaccagaccacucccacgagggcgcuaugcauaaugauacagccuaugggcuucggggaaacgguagggugucuuuccacaagauggucgaaggcaaacgcgaguacauugaagacaaucugaaggugaucgagauuacugauaccaaagcaaucgacagacauggguugcucccgacaggaaagcccaggccuuauaaaggcuacaagggugacucgaacuacugcauagagauuguacggaaugaaaaggggcguugggagggcgaaaucauuagcaccuucgaugccuaucagcuggugcgcaaauacggaaucguucaacuacgauauccaguccuguccgugucaggcaagccccucgugaugagacugauaaggaacgacuuuguccggcuugagcacgaagggaucacucgcacguugagaguuuguaaaaugagggaggauggacagguggcucuggcggacgugacagaggccaacguagaugcacggacccgaacuaaggaaauuugcuacgucuucaaaaccggcgguaguuuacagaaggcuaaggccagacgcaucacaauuucuccuaucggggagcucagggacccaggauuuaaagaauga

SEQ ID NO: 2622 - RNA, 3138 nt, Artificial Sequence
  Cas9 variant
augcagaaggagaaaccccuggccuacagacucgcucuugaccugggcagcaccuccuuggggugggcaguguuaaggcugucugccccuggagaaccaucagcggucauccgggcugguagucgcauuuucagcgauggccgaaacccgaaggacggguccucucuagccguuacacguagagcagccagggcuaugcggcgcagaagggaucggcuccugaaacgcaaggcacgaaugcuugccgcucuggagagacacggauuuuucccccaagacgaagccgcgaggaaagcauuggagaagcucaauccuuauggccugcgggcccguggucuggaaucggcucucaagccagaggaguuugggcgcgccuuauuccaucugaaccagagaaggggauuucagucaaaucggaaaacugaucgaaaggacagcgauaguggcgcacuuaaacaggcuauaggcacguugcgcgcccaaaugcacgaauccgggugcagaaccgugggagagugguucuggaagguaaggauggaacggaaacccgagggugugaagggccaggggguccgcgcgagauacagggagacaccuuuuacuaccgacgaaggaaagaaacguaucgauaagcgguaugaccuguacguggaucgagccaugguugcacaggaguucgacgcucuaugggccgcucaggccacauuugcaccagcccucuucaacgaagcugcgagagcagagcugagggauauucuucugcaucaacgcaaauugcggcccgugcagccuggcagauguacccucgucccagaagaaccgagggcccuguuagcucugcccucuacucagcgcuuucgaaucuaucaggaggugaaucaccuccggguacuucaugacgaacugcgugaggaagccuugacacuagcacaaagagaccagauuguugcccugcucgagaggcaggcuaaggugaccuucacggccaugcgcaaagcacuggguuuuagcgcgcuuuucaaccuggaagaugcuaagcgggacggguugaaaggaaaugccacuaccgcagcccucggcaagaaggaucuguucggcccuuuaugggcuggguuugacacagcccugcaagaugagaucgucacucagcuaaugaccgaggaauccgagccaagacucauagcauggcugcaggaacacacaggaguggacgaggcuagggcccaggcgaucgccaacgcuggucuucccgaaggcuacgggucauugggacgaaccgcacuggcccgcauugugccugagcuccaacgggaugucaucacguaugacaaagcuguucaggccgcaggcuucgcgcaccauagugaucuggguuuuagcuucgagcacgacgccgaugaaguggagagaauuggggaaaggacuaucgcuucuacaggcgagauaaagccaguauuugccuucaaacagcuucccuacuacggacgugcacugcagcgccauguggcuuuugccaaggagaauccgcggaacgacgaagagagauauggcaaaauugcaaauccuaccguccacaucggguugaaccaagugaggguuguggucaaugcccucaugugccgauacggacggcccacugaagugguaauugagcuggcucgcgacuuaaagcaguccagagaacagaagcuggaggcgcagcaaaggcaggccgauaaccagaaacggaaugcacgaaucagacgcucaaucgcugagguucuagguauuagcgaagagagggugcguacacucgacauacagaaguggauccugugggaggagcuuagucacgaugccgccgaccggagauguccauauucuggcguccaaauuuccgcuagcauguugcugggggaaaggguggagaucgagcauauacucccuuucucgaugacccuggaugacucuuuaaacaaccgcacggucgcacugcgagaagccaauagaauuaaacggaacaggacccccugggaugcgcgcacagacuuugaggcucacggaugguccuacgauggcauccuucagcgugccgaaagaaugccacagcggaagaggcaucgcuucgcacccgacgguuaugagcgaugguugggggaagauaaagacuuucucgccagagcucugaaugauacucgguaccuaucaaggguggcagccgaguaucugcgccucguuugcccuggcagugcgaccagagugaucccaggacaaaugacagcucugcuuaggggcaaguucggguugaacgacguacugggauuagacggugagaagaaucggaacgaucaccgucaucacgccgucgacgcaugugugauuggcguuacugaucagcgcaugaugcagcgauuugcccaggcuaaugcccaagcaagagaagacgggcucaccaggcugguggaggauaugccgcuucccuggccuacauaccgggcucacgucgaacgcgccgugagacauaucuggguaagccacaaaccagaccauggauucgagggcgcgaugauggaggaaaccuccuacgguauucugagggaugggacuauaaagcagcggcgaaaagccgacggcucugcaggaagagagaucagccgcuugauuaggaucacggaacccucacagccucagcggcacggcguggaugcugaggggcguccacuccccuauaagggauacguuggcgguaguaacuauugccuggaaaucacagucaaugacaaagggaagugggagggacaagugauuuccaccuucgaugccuacagaauagugagggagggcggucuacgccagcugcggcacagcacucagggccagaacgggcaagcucucgcaaugcgacuggucaucggagacucuguuagacuugaaguggaugagcaggaaagggugaugcgcauuguaaagaucaauggcaacaaugggcaggucuuuauggccccggugcaugaggccaacguugacgcucggaauagcgacaaaaacgaagcguucgcauauaccaguaagauugccggaucauuucagaaaacaaaggcuagacaagugaccaucuccccuauaggcgaguugcgugauccagguuucaaaggguga

SEQ ID NO: 2623 - RNA, 3138 nt, Artificial Sequence
  Cas9 variant
augaagcccagaaaccugaauuacauccucggccuugaccuggggauugccagcgugggaugguccgucguugagauagaugaaaacgaguauccuaucagguugauugacguggguguacggaccuucgaacgcgcugaggugccaaaaacaggcgaaucuuuagcacuggcccgacgucuagcgagaucaacuaggcggcucauccgcagaagggcuuuucggcugcuuaaggccaaacgccuguugaagcaccaucagauugucaaugcagaggagcucacgcaacugccgaaccagugcugggaacugcgagugaaagggcucgauaguuuacugagcaauaccgagugggccgcuguucuuuugcaucugcuaaagcacagaggauaccucucccagaggaagaacgaagcacagaaugccgacaaagagcugggcaagcugcgggaggguauggauaacaauucuaaacuguugcucgaaaacaauuaucguacacccgcugacaucgccgugaagaaauucgcggucgaggaagggcacaugcgcaaccaaagaggagcauacacucauaccuuuaauaggcuggauauauuagccgagaugcagcuucucuucaagacacagcgggaacuuggcucgaccuaugcuaacggcgagcuggagcaggccuuuugugaauugcuacuguggcaaaagcaggcacucaaucgaucacagaugcugagccuuguggggaaaugcacuuucgagaaggaagagaaacgcgcugccaaggcgaguuacuccgccgaaagauuuguagcaauccagaaacugcaaaacuugaggauucucgagaacggagaggaacggggucuguucgacucugaguuuagcuuacugcuagaaaaugcuuauaaccucaaguccggccugacauacaaacagguucgcaagauccuuucauugagugagaaugccauuuucaaggggcugccuuaccucagcgaugaccuggaaaaaccagagaagacccaguuucuugcuuucaaauuuuaucaccaacuggccgauaucuugaagaacaauggauucucugacgaguggcagaaacucucccaggaacccacgcuguuagauaagcugggcacugagcuaucacucuguaaggaagagaacgaguucauagcacaguuuaauggugaacugccugaggccaugcuuagcaccuuguucaaccacacaaauuuugacaaauucauucauaucagucugaaggcucucaacaauauucugccauuaauggaacaagggaacgacuacacuaaagcguggagaaagguguaucccgagccuaccaaaaaggaugaaaagacacugccaccgauccccgcagacgagaucaggaauccugucgugcuucguucuuugucccaggcccggaaagugauuaacgcugucauacgacucuacggaagcccagccagaauccacauugagaccgcaagggaacugggcaagucguaugaugaccgccagaaaaucaagaaacagcaagauaaaaauucugacgagcgggaucaggccguuaagaaguuucuagaagagugccccaacuucgcuaacaaggugaaaggcaaggacauacugaaaauuagacucuacaucaaucaggaugggaagugucuguauuccggaaaaccucuugacccacauagguugcuggaaaucgguuacguagagauugaucacgccuuacccuuuucacgcacgugggacgacagucagaacaauaaggugcucguccuggcaaacgagaaucaaaacaagggcaaucagacuccguucgaauggcuugggaaagaugagcaccagugggcgcuguuuguggcucgaguuaacggaugccgguucccuuacgccaagaaacagcguaucuugacaaagaaacucgacgaacaaggcuuucugaagagaaaucuaaacgauaccagguaugugagcgcauaccugaugaagcauauuaaagagaaucuccaccuggucgguaagggguccgacaaaguguucgccucuaacggccagguaacuaauuuucuucgccgguguuggggauuggaaaagaaaagagaggagggcgauaggcaucacgcucuggacgccauaguuguggcaugcagcacagcuucaaugcgacagaagaucaccuuauucaagaaauaucaacgcuggaaccucaagacggggaaacauauugaucaggaaaccggagagaucaucccccugcacuucccagccccuugggacuuuuuccggcaggaagucaugauuagaauauuuagugagaugccccaggaggaucuuaucaugcaacugccagacaggccccaggcgaaucacgaguucgugcagccucuauuugucucccgugccccaagccgcaagaugucuggucagggccaugaagcuaaacuccggucagcaagaaugcuggaagccacagggaagaguauuaagaaagaguucuugacugaucugaccaucaagaacuuagaacacauggugaacaaagagagggagccggaacucuaccaagcucugguugagcauuuuaagaaauauggagacaagcccaaagaaaaguucuuuaagaaaggcgguguggagguaaagagcauucgaaucuccaaaacacagaauaagucugucaaccuugggaauaaaacuauagccgauaacggcgacaucgugcggaccgaccuguucuugaagaauaagaaauacuauuuuguuaacauuuacgcauggcaagugucgaagggaauccucccuaaagaaacaaccacuggcaauauucuggauaacagcuacgaguuccaguuuucccuauucaagaaugaccugcuugagaucccacaccccaaaaacgaaaaugauucaauacucgcguauuucauucgcccugacgaugagagaagguggauccugaaguuucacgacaacgccaagauuccagauaucuacgggaaaaaggacgaaacgaguauacgguugucuauccagggacagaaauucauuaagaaauaucaggucgaugagcuggguaagaauauccgacccuguagaccgacaaagcgccaaggcgugagguga

SEQ ID NO: 2624 - RNA, 3141 nt, Artificial Sequence
  Cas9 variant
augaagaucuacagcuucgacauuggcguggccuccauagggugggcuuuuaucgagaacgaaguccugcaggauugcggaauuagaaucuucaccaaagcagagaaucccaagaacggugccucucucgcgcuuccuaggcgggaagcucgcggcguucgaaaacgucuggccagaaggcgggggcgcuugaauacaauuaagcaguuacuguguaaagaguuuggacuacagcucgaagacuaucugucaaacgauggcgagcuuccaaaggcauacacugccaguaaggcuaauccgcugaaaagccccuaugaguugagaacgcucgcacugucccagaagcuggacucuaaagaucucgugaggguaaucuuacacauagccaagcaucgggguuacgggaacaaacacgcuaaggacucgaaggauaccgaaucaggaaaagugaagaaagccaucgaguucaaucgcaagacacuggcggaaaaaggcuaucgaagcgucggcgaguaccuuuauagagaguuuuuccagcaaaguaggauuucccagaacaauggggcaacugaauuugugaacguucggaauaagaccggaaacuacgagcauugcguggcccaggacauguugaaagaugaacuggagcuaaucuuccguaagcagaaggaacucggucugcaccuuucugacggcuuugagaaacaacuguuggauaagauuuucgagcagcgcccucucaagagcuuugcugacaaagucgggaaaugucaguucaucgccggagcaaagagagcuccaaaggauuccauaucagccauugaauuuguggcgcugaguaggaucauuaauacauuagccaaccugagcaaaaagucuggcgagauguacgacaaagcaaugguacucaccauccuugacuccguucuggaaaagggugagaugucauauuacgcuuugcgggaagccaucaaucuagaugagaaaauucgauucgcugacagccgccuggauuauaguaaggagauaaaggaaacugagaaagugaaguucgucgaaugcaaaaaccucaagucuuuuaaaaaggugcuggggaacuguuacaagacacuugagagaaaacauaucgacuccauugccgaaaggaucgcagugauaaaggaugucgagaaacugcacaaggaguuggaaagcuauugcgccaccgagcagcucucgcugacgucugaacaaauucaggcuuuaucccaccugaauuucucaagucauaucagccuaucccucaaagcgcuggagcagauccuucccuuuaugcggggagagcgcgaagcaagaucuagcgacgccgauuacuguauuggcaucgacgagucaggcgaaagucaaugcuugagguaugaugaguccguugaaaaggcugggcugaaagcccucagcaaggacacucugaagggacagauucuuccuccacugaacgaguucgagcccuacuuggcaaauccugugguagcccgugcucucgccgaauaccggaaagugcugaacgcauuacugaagcaguaugguucuccacacaaaauacauaucgaguacgcgcgagaagcuaagcuaaauaccacagagagacagaaauaugaaaaggagcaaaaggauaacuacgccgcaaaucaggccgcucacaaaaagugucaggagcucggccuggaaccgucaaguacuaaccuuuugaaacugaagcucuggcaggagcaagggggacugugcuuauauagcggcgccaaaauuaccaucuccuaccugcaggaccccacagcacuucaggucgaccacaucuauccuuacucuaggucguuugaugacagcuacaugaauaaguguuuggugcucaccaaggcuaaccaggaaaaagguaaucgcacgccauucgaggccuuugggacugauuccgcgaaguggggcguuauuacaacccuggcccaaaaacuaccccauaagaaacggagaaggauacugaacacugcuuucaaugacaaggaagcaggauuuaagcuccgcaaccugaaugauacaucauauaucgcccgacuuguggcugacuacaccgagacguauuuggaguuccugaguuuagucgaaucugagaacaccacacucggcaaagggcagaagggaagcaaaaagcacauugccaucgugaacggugcacugacuuccaccaugcgguacuaucuuggcuuugcgucaaaagaucgugacaaucaucugcaccaugccuuggaugcuguaauuaucggguucaugaacgacagcguuauaaaggccuuuucugauuucaaaaagacacaggaaacuuccaaggcagcuuacuaugcccacacccucaguaaacaggaguacaagaaacaaagagcauucauccagcugccuagcggagagaauuuuagggccaacgugcuagaaaaggcugagucugucuucguguccaaaccaccccgcaagcgggucagaggcgcgcugcacgaagagucauuuuacagucagaaugacacaaagcuccugaaaagcuaugguggggccgaaggcauugagaaggcacuucaauugggaaaaaucaggcagauuggcaccaagaucgugucgaacggggcuaugguucgaguggauauauucaaacaucgcaaguccggaaaguuuuacgguguaccggucuauacuauggacuucgcccugggcauuuuaccuaauaaagccgugguucaggggaaggacaaaaacgaugugaucaaggacuggcucgagauggauucuagcuacgaauuuauuuucucacuguauaaagacgaucuucugcuaguccagaagaaggagauggcugaacccgagcucugcuacuuugugaguuucgacacguccggagcaucuaucaaaguagccaagcacgauaauaacuuuagcacacugaccgaaaaucaaaaauugcuguucuccaacgcgacuaaggaggaggugguuggcaaaucaauagguauccagaauuuaaaggucuuugaaaaguggcaagugagcgugcucggggaggucaaacggacccagaguuauccaagagaaaacauuucucuggcuuccaaggccaaaaaguga

SEQ ID NO: 2625 - RNA, 3144 nt, Artificial Sequence
  Cas9 variant
augaagcugcucagauacauccuuggccuggacuuggggauugccagcgugggaugggcuauagucgagaucgaugaaaacgacuuccccauuagguuaaucgauauugguguucggaccuuugacaaagcagagguguccaagacaggcgaaucucuggcccuagcgcgccgacucgcucguucaacuagaaggcugauccggcgcagagccuucaggcuucugaaagggaagcgguugcucaaacagcacaauguaauaaacaaggaggcacugacgacccugccuacagauugcugggcccuccgcgugaagggauuagacgaacgacugaguccaacugaguggagcgcuguccuuuugcaucugcuaaaacacagaggcuaucucucccaaaggaagaaugaggcaaaaucugccgauaaggaaaugggugcucugcuuucggggguggccucaaaccaucagcuguugguugagaaucaguuucggaccccggcggaaaucgcagugaaaaaguucgcccucgaggagggacacauucguaaccagcugggcgcuuacacacauaccuuuaaucgcuuagaccugcucgccgaaaugaaacuucuguuccaaacucagagagaguugggcaacccccacacaagcgggcagcuagaacaggaguuuugugaacugcucauguggcaaaagccugcacugaguggagaugcuauccuuaagaugcuggguaaaugcaccuucgagacgaaugaguauaaggccgcgaaacacuccuacacugccgaaagguuugucugguugaccaagcucaacaaucugcggauuuuagagcauggcucugaacgagugcugaacacagacgagcgcagccuacuccugaaucagccauaugaaaaagcaaaacuuacuuacacccagguaagaaaguugcuggggcucuccgaggaggcuagguucaacggaguucgguauggcaaggaaaaggccgaggaugcuacacugaucgaacuuaaagccuaccacgcaauacgcaaggccguggagaaagcugacaagucagcgugggaaacccugaagaaucagacggcauugcucgaugagauugguacuacauuuaguaucuacaaaaccgacgacgauauuacugagcaacugaacgggaaguuaagcgacacaguccugaacgcccuacucgaaaaucugaacuucgauaaauuuauccagcuuucuuugaagucccuguauaauaucgugccccucauggagcagggacugagauacgacgaggcuugucaacagauuuauggcgaucauuucggcaaaaagucaggggagauaaacagguuacugccuccaauccccgccgacgagauucguaauccugugguccuucggagcuugacccaggcacgaaagguuaucaacgccgugauaagacucuacggaaguccagcuaggauucacaucgaaacggcccgcgagcuggguaaaucuuauaaggaucggaaagaaaucgagaagagacaggaacaaaauagggcagagcgcgagaaagcgaccgcucaguucaagacacuauuuccgacuuucauuggcgaacccaaggggaaagacauccugaugaugcgacucuacgagcagcagaacggacaaugccuguauuccggcaagccucuuaauuugaaccggcuguuagaaaaagguuacguagagauugaucacagccucccauuuucgcguaccugggacgauucucagaauaacaaggugcugguccuugccggggaaaaucagaacaaaggcaaucagacacccuucgaguggcugggaaaggacgagcaucaaugggcauuguuuguggccagaguuaacggcuguagguucccuuacgcuaaaaagcagcgcauacucacucagaagcuggacgaacagggguuuaucgagcggaaccuaaaugauaccagauauauugccagguuccuggugaacuuuguccgagaaaaucuccaccugacaggaaaagguaagaaccgcguguucgcauccaauggccaaaucaccgcuuuucuucgggggagauggggauugucaaaaguaagggaggaaagugaccgucaucacgcccuggaugcgguuguggucgccugcagcacuguggcuaugcagcagaagaucacgcgcuucgucaaauaccaagagggcaacuuacagacagcagagcggauugacagagaaaccggugagauaaucccacuccauuuucccgauccguggcacuucuucaggcaggaagugaugauucgaaucuuuuccgagaauccucaggaggaccugauuauccaacuucccgaucggccagaagccaaccacgaguucguucagccucuguuugugucucgcaugcccacuagaaagaugagcgggcagggccauauggaaaccauaaagucagcuaaaaggcuagacgagggaaucaguguauccaaggucccacucacacagcugaaauugaaggaucuggacaauauggugaaccgggaacgagagaaagccuuauaugaggcacucaaggcgagacugaaugccuucaacgaugaccccaccaaggcuuuugccgaaccuuucuacaaaaagggcgggcaacagguuaaagcagugcgcgucgaacaggugcagaagucuggaguagugguuaggaaugguaacggcgucgcugauaaugccagcauggugcguguggacgucuuuauuaaagggggaaaguauuuccuuguuccaaucuacacuuggcaaguggcaaagggcauucugccggaccgggccgugguagcugcgaaagaugaaucagagugggaauugauggacaagacagcccaguuucucuucaguauguuucccaacgaucugauccaggucaaaacgaagaaagagaccuucuuugguuauuacaacgggcuagacagagcaacuggcgcuauaaaucugaaggagccugauagcaacauuaauaaaggaaaguccggccuucacaggucuaucggggugaagacagcccucucgguugaaaaauaccaaguggacgagcugggaaagaacauucgcccaugucgacccagcaaaagacaggccguccgguga

SEQ ID NO: 2626 - RNA, 3147 nt, Artificial Sequence
  Cas9 variant
augaagagacugggccucgacaucgggaccaacagcauuggauggugccuuauagaggaugacggugauggcaaagggaggaucauugacaucggagcccggauuuucuccgauggccgcgaccccaagucuggugcuucacuggcaguggaucgacgugccgcgagagcuaugaggcggcgcagagacagguacuuggggcggcgcacagccuuuuuaaaagcacugaagcgauucggacuaaugccugccgaugaaagugcugcaaaacuccuggccgacagagauccauaugagcuuagggcucgggcccuggacgaacguuuggagccgcacgaaaucggccgcgcgcucuuucaucugaaucagagaaggggcuucaagagcaaccggaaggcagagcgaaaaacuaaggaugccgaggacgggaaaauagcuaauggagccaaggcacuggaccaagcuauggccgaauccggugcggagacgcucggccaguuuuuaucuucgcgcgauaccaaaagagucaggauggggucagacgcccagggauacgauuucuauccccagcggcgccacguugaauacgaguuugacacaaucuggagcagacaacagcagcaucacccugcacugcuuacugaggaagcuaggaagaaguugcaugauauucuguucuuucagcguccacuaaaagagcaagaagugggcguauguaccuucgugcacaacgagugccggcuccccaaggcccacccucuguuucaggaacgaagacuuuaugaggaggucaaucagcuggaaaucacaaccccaggugcucccaacaggaaauugacuauggacgagcgcgaugcccucauucuggaauuacggaguagaaaggagagguccuucgacucucuggcaaaacgccucaaacuugccccugggcagagcuuuaauaaagcauccgaaucacgaacacggcugcguggagaugagguguacgcgguuauggcacauaagaagagauucggcgacagguggccacacuuggaucgcgaccggcaaugggccaucauaaaaagaauuaucgaggaagaggacccggauaagcuacaugcuuuccugaccggcgaaugggggcucacggacgagcaggcccuggcaacugccagggcuccccuuccugaacuguauggacgauuggguccaaccgccacagcacgcauucucgaggagcugaaaaaggaugugaucacuuacgacgaagcgguccggagagcuggcuggcaccacagugaugacaggaccggggagaucuuaccccagcugccuuacuauggagaacuacucacacgugauauuccacccggcacccaagacccgaacgauccucccgagcagcgcugggguaaaauaacgaauccaacugugcauaucgggcugcggcagcuugagaaguugguaaacgccauuaucaagguucacggcagaccugaccagauaguggucgaacuggcaagggagcucaaacugaaugaaaaggauaaagaggaacauaaccgacggauucgcagagacacagccgcugcccaacuuaggagcgcaaagcugcagucugagggaauccccgauaccggcgcuaaucggauguugcuccgaaucugggaggaacugaacccaggggagguguuagacagacgcugucccuacugcggagaaccuguggguaugaggaugcuguuugccggcgaggcggacauugaucacaucauuccauauucccguucacuagacgauagcgccgggaauaaagucguugcucaucggaguuguaacagagcaaagggaaacaggacuccguacgaaaagugggugcacgaccccgaucgcugggacguaauaucuacacagguggcccgacuccacaaauccaagcaguggagauucggcccugaugcuauggcccgggucgagaaagacgguggguuuaucgcaaggcaacugaccgauacgcaguaucuuagccgcuuggcgggccguuaccugucgucucucuauccaaccaaggacgauggauccguguacguuauucccggcagaaugacagccaugcugcggaggcgcuggggguuaaauucacugcuuccugaccauaacuucguggauaaugagcacaguaacgcuccaaagaaucgauuggaccauagacaccacgccaucgacgcagcugucguggccguaacuacccgggcacucaugcaggaaaucgccaggacagcuggacgcgcggaggauaaggaccuggauagacuauuugaagaccugccccagccgugggaggguuucagggaggaacucggcgagaagcugguucgggugacugucagccauaaaccugaucacgggcguaagggacuuccacccaaaaaccgcgacgugaccgccggccgauugcauaaugauacagcauacggucugaccggggacgucgcugccgauggcaagacuccuauugugguucacagagugcccuuaaugucccucaaaccagccgacauaucugauccugacaggauccccgacccagcucugcggagcgcacuucaucgcgccacggauggacugucaggcaaggcguaugacgcugccuuggcaggguuugccaaaacacacccgcaauucgcuggaauuagaaggguacggguccgagaaccucucaccgugauccccauugcagauagagacggccgcccauuuaaggccuacaagggugaugcgaacaguaggguugacaucuggcggaugcccgaugggaaauggcuguccgacguggucacuauguaugaggcucaccguagagaucauagcgacaggcgcccucacccagccgcaaagaaacuaaugucucugcggcagaaugauaugauagccguggaacgagacggagcucccagacagaucaugguagugaagcagauuuggccuacccaaaucaaccucguugagcauaaagagacaggcaaucugaaggauaggcacucaaacgaaaccgacccguuccgcuuuuucgccccaacugcugguggccuuaagaaaaugaaggcucggcaggucagaauugaccccuuggggcguaucuuugauccuggaccaagguga

SEQ ID NO: 2627 - RNA, 3147 nt, Artificial Sequence
  Cas9 variant
auggccaacaucgcugagaaucugguguucggcauugaccucgggauaggaagcugcgguugggcaguccuuaaccagaaggccaaagaugaaaauaucguugcgcugggcuccugguguuuugacgugcccgagaccgauaaggaaaggauuccuacaaaccaaaucagacgggcuaaucgcuuguuacgacguguaauuagaaggcggcgcaacagaauggccgagaucaggcggcuguucgcaucuaaagggaugcuagacacugccgauccagacgcucucgcaaagauaucagccgauccgugggaaaugcgcgcuaaaggacuggacuaccagcuuacgccccaggaguuugccguggcgcugggccacaucgcaaagcgaagagguuucaagagugccgcuaaaagggucagcaccaaugccccuuccgaggauucuaagauguuggcagcucucgagaaaacaaaggagcagucggcccaauaucggacuauuggggaaauguuugcgcgugacccagccuacgcagaucgcagaaggaaccgggacggaugcuucgaucgaaccaugucacgcgaggaccuguuuaaagagacacagauccuguucgaaagccagagaaggcucggcaauuuuagugcuaccuccgagacugaacaggccuucauugacaucgcuuuucggcaaaagcccaugcaggauucugagcgcuuaguggaaacaugucuguucgagccugacgagaagagagccagcagguuugcaccauccuucgaacguuuccggcuuuugugccgacugguuaaccuaagagugaccgauggccucgaggacaggccccugacgccugaagaacuucgccuggccugugaagaugcugggaaaacucggaaguugucagucaaaaaggugagaagucucauaggacugagggacgaucagcgcuuuaccacaauuccaccggaccaggagcaacaugauaucgcggcacgaacuggugacgccuuaaccggcacagcuaccuuccgggccauucugggggagagcuuuuggcgucagcuccuuccccacccugaacagcuggauagagcagccuggaucaucucuuuccaugaguugacggacacuauuauauccaaacuagcuacaaucggacugccaucagaaguaauggagcucauuaggaaggcccuggaagacggcaaauuuagcaaguucaagggugcagcgagucuuucugauaaagcugcccgcaagcugauccccuuuuugcaagaggggcucaccuaugacaaagcaugccagaaggccggauacaaucacgcugccuccaaauucacucauuaugauagcauagacacaaaggcaaaguuuaacucgcugauggaugacguucgggauucuauuaccaauccuguggcuagaaaagccaucuccgagggcaugaagcaggucugggcgaugaggaaccaguggggcuuaccaggggccaucuguauugaacuggcucgagacgugggaaauucagcagagaaacgccgggaaaucgagagugguauuaagaaaaacacggcccaaagagagagggaacgucaggaggcuaaggaacaccuaaaccagagcgauauauccucugagacccuccugcgcuaccggcuuuggaaggaacagggcgggagaugcuguuauacagaccaacccaucacuccgagccaguugauugccucagauaauagugugcaggucgaccacauccugccuugguccagguucggagaugacagcuaccucaacaaagcacugugcaccgcgaaggccaaucaggagaaaaagaaccgaacacccugggaguggauccauaaucaaaaaggcguugaggcuuggaaccacuuuacugccgcaguggaaucucggaaggaaacccgcggucuuaagaaaagaaauuuccuguugaagucaaguaaagagacagaagagagguuucggagccgaaaccucaaugacaccagauacgcugcccgcguaauggcagaggccgugaggcuguuauauccauccgggaaccgugcugaaaagggcggagucaaacggguguucacuagaccuggcgcgcugacggccgcacuaaggcaugcuuggggaguugagucucucaagaaaauuaaugggaagcgccugaacgaugaccgacaccacgcccuugaugccgcuguggucgcagccgugucggaaaaggagauacagaaauugacaaagagcuuccagaucugugaacagaaaggucuggcgagacccaugcgggacguaccaaugcccugggagggcuuuaggcaucaacucgagaccgcuuacgccgauauucgcguugcacguccugaaagacggagggcccgcgggaagggacacgacgcuacuauccgacagcugagagaggaaaaagauggcccaguggucuaugagcggagggcaauuuccgacuuaaagcugaccgaucuugagcgcaucaaggacccggaaagaaauucagccauaaucaguucuuugaggacauggauugagaaagguaagcccgcggauuacccuccacagagccccaaaggggacgaaauccggaagauucgugugaugucccgcaacaaaccugcugucucagugcgaggcggaaccgccgauagaggcgagaugacuaggguugacguguucacaaagauggggaagaaaggaaagccagaaugguuucucguacccaucuaucggcaucaagucauagaccgcauucaguggccgcagccuccaaaucaggcagccgcuaacgguaaaagcgagaagaacuggcccacgaugggccuggagcacgaguucagauuuucucuauacccuagguccuaugugcaaaucguuaaacgggauggggaaauuaucgaaggauacuucgccggccuggaccgaaccguggcagcuuuuagucuccugucuagcuccgaucccacuucaauacagagagguaucggggccaagacacuugagaguauucgcaaguacaaugucaacagguucggcgacaucagcaugguggaacaggagacccggacauggcauggagauguaugcauuucgccagaccagccugauuccgcguga

SEQ ID NO: 2628 - RNA, 3147 nt, Artificial Sequence
  Cas9 variant
augguggagaagauccugggcauugaccucgggauaagcucccuuggaugggccgucguugaauacgauaaagacaacgaugagaauaacaagaucauugacugcggugugagacuguucaccgcugcagaaacacccaaagagaaggaaucuccuaauaaagccaggcgggaugcgcgcggcuugcgacguguaaucaagagaaggcgggugcgcaugaacacuauuaagaauuuacugaucacguauaaacuaauagacaagacccuccuggaugaggagauggggauguuucacucacagaguaacagagucgacguguggaaacuuaggcaugaugcucuguaccacuugcucagcggagacgaacuggcccggguucugauccauauugcaaagcaccgcggcuauaaauuccucggugaugacgaguccgaugaagagucugggaaggugaagaaagccggagcugaguuaaagaaaaaguuucuggaagcaggcugucaaucggucggcgaguggcuuuggaaagaacgaggguugcagggaaagaaaagaaauaagucaggugacuacgagaucagcauuccaagggacuuccugguggaagagauccagcggauauuugagacacagcaaaaguucggcaguacuuuugccaccuccgaacuacagaaggcuuauacagauauugccuucuacguaaagccgaugcagucuaucgaggacaugguuggguauugcaccuuuuaccccaaaauuaagagcaaaaaccaggauggagaaaagcgugcgccuaaggcauccccaucagccgagcaauucgugauccucaguaaaaucuuuagcacuauugucauagacgaaaauaagcaggagaaaaagcugaucgagcuuaaaucuauugaacagcugauccagauagcucgcuccaaggagacauugaaguacaaacaacucagaaaggaacugaacuuagccaaagauauuucauucaagagcaucagugacgaggagaaaaccuggaucaaucuggugggcaacgcaaaguuuaagaaaauucucggucuuaauuaugaaacguuccugaagaacacugagaucucugaugaaauugcuaaaauauugaccuacgacaagacauucgagcagaaagaaacuaagcugaaaaaucuacucgugaacaucgauuggauugacaacaaucauaucgccgagcuggcgaaacuuuccuuuagccaguucaaccaacugucguugaaggccaucaaaauuauaucuaagaucaugauugagggguaugcaagguacgaugaagcuguccaguaugccuuugagaauaaccuccugcccaaaccuucccacgaaaagucaaucuuacugccaccccuaaaagagaccaauauugcuauccucaacccuacaguuauacgggccuucgcacaguuucgacagguggccaaugcucugguaaguaaguacggcagcuucgacaaggugcacuuugaacuugcgcgcgaggucaacaccaaagaggacagaaagaggugggaaaaagaucgggacaagaaugagaaaaugcaucgccaaaucacggaaaaguugguggaggaaggaguuaagccauccuauaaaaacauucugaagucuaaacucagaagcgagcagaaggauacuuguccguacugccagaaaaaucugcacuaccccaugaucuucgaggacggcuaugcagaaauugaucauauccuuccucugucacagagucaagacgauuccuacgugaacaaggucuuggugcacagcgccuguaaucagaacaagaaaaauaggacaccauuugagugguuccaggacgaaaagaaagauugggacaccuuuaagucuuauauacucauggagucaacucugggggagaaaaagcguaacuacuuaauuaaagaaaacuucagugauccccagagccggaaggaguuuaucucccgaaaucugaacgacacaagauauaugucuaaggcuauuaaaaccuacugcgaaaaucacuggaagcuaucgcaugaugacgacaaacucaggauccaaguacgcagcggaaagcugacguccacccuucggcaccagugggguuuggauaacaaaaauagagagacacauacucaccaugccauggacgcaauaaugaucgccuucucaacccagggcaugguuaagaagcugagugauuauuucgcuaaaaaggaagccaaaguggagaaggacaaaccuguccucauuacaccaaucaagcaguuuaaggaggcaguggaacaagcgacuacccuggagaggcaggaaucuauucagacaaaagcuggggauaccaucacuuuaaaccgccugcuuauaagccgacccccgcgggccuccgucacgggagcagcccacgagcaaacagcuaagccuuacccccguauuaaaccaaucaagaauaaauacaagagaaggcgcaucccuauugacgaagauaaguucgaguuguuucggaacgacaaaguggccucaggcaaugauaagaacuucuauaauagcucuaccauccccagaguugacauuuacaaaaaggaugacaaauaucacgugguaccaauauaccucuccgauaugacuaaggcagagguccccaacaagagucuggguaccaauccugaagggauggacgagaaauauuuuuguuucagcguguuuaagaacgaccuaaucgaacuggagacaaaagcuaccccaaagaaaccgucuaagaaacuccugggcuacuucaagcagcuuaauggagccaacuuuauuuugaacuccauccauaauggcauuaucgauggguucguuugcucacccauaacucuguuuaagcagcagaaagacauguguaagaaaugcuuaccugaagauagggcgaucggaaacuguagucaagagacacucgaguucugggaagccgagaauauuaaggugcccaaaaaggacuuugaaugcgaucaggguaucaaguucgcuauugcaguccgaaaauauacgaucgacccacugggcuacuaccacgaggugaagggggaaaaacuucugggaaccauaccucagggcgccaagaaacauccaaagcgccagaaguga

SEQ ID NO: 2629 - RNA, 3150 nt, Artificial Sequence
  Cas9 variant
augaucaacgagagacugaccuucggcauugaccucgggauaggaagcugcgguugggccgugcuuaggcacgcugaugcagccggcgaacccggggucaucgagggacugggcuccugguguuuugacguuccugaaacaucuaaggagcggauuccaacuaaucaggugcgccgaucaaaccguuuguuaagaaggguaauccggcgcagaaggaaucggauggcggaaauucgccgacuguuccaugcucaaggucuacucccgagugccgaugaggacgcacugaaaagacccaggcuugauccuugggagcugcgggcccguggguuggaccagugccucagcgcugaagaguuugcaguggcccugggacacaucgcucgccauagaggcuucagguccucugccaagcggaaagcggcaaacacgucgggcgaagauucaaagaugcugagcgcccucuuagucacccgagagcgcacagcuagauacaggacugugggggagauguuugcccgggacccagaauauagugcacgcagaaggaaucgugauggaauauucgaccggaccguugcucgagaugaccugauccacgagguggguaaacuuuuugaagcccagagagcgaggggcuccgccuucgcaucucccgauuuggaggcugacuuuaacgccauugcuuuccgccaggccgaaaugcaagacagcgagcggcuggucgggaauuguccuuuugagagagaugaaaagagggcagcccgcugggcuccauccuucgagcgauuucggcuacucacacgucugaucaaccuuagaauugcgaccgcagaaggagagaggcgcuucacucccgaagaccuggcccgggugucagcugaguugggcgccacagcaaagcucccuguaaguagaguuagggcccugaucgguuuacugccagaugagcgauucaccacgauacgcguggaagacgaggaucgggacauugucgcuagaacuggggaagccgcaccgggaaccuggaggcuccguaaaacacuuggcgaggcgcugugggcugaaaugcaggcccgccccgaucaguuggacgcaaucgcccaugugcugagcuuuuucgaggcuacugccaagauucggucugagcuggauagacucggccugccugcagcugugaucgaagcccuugacagggggcuggaggauggagcguuugccaaauucaagggugcuggccacaucuccgcaaaagccugccgaaauuugcucccacaccuacagcaagggcaucgguacgaccaggcuugucgcuuagccggauaugaccacgcagcgucaacccugagccauacagcccaggucguuaguaaggcuggcuuuaacgcccuagugaccgaacucggugagucuauugcaaaucccauagcuagaaaggcccugacggaggggcuuaaacagaucagggcaaugugcgcccgguggggcuugccuggagcuauucacaucgaacuggcgcgagagguaggcaacuccauagaaaagagacgcgagcucgaaagccaaagggagacuacaaccaaacgucggcagacugagagagaugaaauuagggggcugcuugcccuggaggacguggaugacgauacauugcuccgcuaccgacuguggaaggaacagggagguaaauguuuauauaccggcaaggacauccacgucagacaacugaucgcaacggauaauucggugcagguugaccauauucuaccauggucucgguucggggaugacuccuuuaacaauaaaacccucugccuggcuucagccaaccagaggaagcgcggacagacacccugggagugguucagucuuacuggcaccccggaagccugggagguguuugcuagccgugucgagacauccaaggauuugagagguuucaaaaagcggaaccugcuccugaaaaaugcagacgaaguggcccaaagguuucgcucucgaaacuuaaaugauacuagauacgcggcucggcugcuugccgaggcagccaaguuguucuauccugcuggggacaggcaggaaaaagacggccgcagaaggguacucacccggcccggaccacugacagcagcccuacgucacgcguggggccuggagagccucaagaaggcugaugggaaacgcguuucagacgaucgacaucacgcccuggacgcacuugccguggcugccaucagugaaagagagguccagagguugacccgguccuuucaggagugggaacaacagggacuggcacgcccuuuaagacauguggcucccccauggcccgguuucaggggcgauguccucgccgcguacgcccaggcauucguggcucggccugagcgaagacgcgccagggggaagggacacgacgcuagcauucggcagguugugggcgaagguccagaggcacaaguauuugagcguagagggcuggccgaucuuaaagaagccgaccuggauagggucaaggacccggagcgcaaccaggcuauaaucgaagcggugcgggcauggauuuuggccggccgacccgcugaugccccuccaagaucucccaggggagacguuaucgugaaacuccgcacugccccugcaaagaagaucaaaccagcuguccccgugcggggcgggacggcggauagaggagacaugguacguauugacguguucacaaggccgaaucggaagggccgcgaugagugguaccugguuccuauauauccacaccaggucaugaaccgaaaagccuggccccauccucccaugagaucagugguggcauacaaggacgaagcugguuggaccgagaucggggccgagcacaguuuuagguucagccuauauccacgguccuacguccagcugguuaaaucuaauggagaugugauugaaggcuaucucgugucgauggaccgcagcacuggugcauuuagaguauucguccauaacaauccugccgagauggcuaagggcaucggggccaagacccugcuuaacuugaggaaauuuaauguggaucgauucggaguucggacagaagugaaguccgagguccguaccuggcacggcgaaguguguacuucacccguuccaccggacuga

SEQ ID NO: 2630 - RNA, 3150 nt, Artificial Sequence
  Cas9 variant
augcagcugagcaagcucaacuacauccuuggccuggacuuggggauugccuccgugggauggucugucauagagaucgaugaaaccgagaugcccauuagauuaaucgacguuggugugaggacauucgaacgggcugagguaccuaaaacuggcgaaucacuggcacuagcccgccgacucgcgcguaguacgagaaggcugauucggcgcagagcuuuuaggcuucugaaggccaaacgguugcucaagaaucaccaaaucgugagcgcagaugagcuguccacccugccaaaccauugcugggagcuccgcgucaaaggguuagacgaacgacugacaugucaggagugggccgcugugcuuuugcaucugcuaaagcacagaggauaucucucucagaggaagucggaagcacagaaugccgauaaagagaugggcgcucugcuuucagguguugccaacaaucacaagcuguugagcgagaaccauuaccggacuccggcggaaauagcagugaaaaaguucgcccucgaggaagggcacaugcguaaucaacgcggagcuuauacccacacauuuaacagacuggacuuacuggccgagaugaggcuccuuuuccagacccagcgggaacugggcagucccuacgcauccggcgaguuggagcaggaauuuugcaaacuacugauguggcaaaagccugcucucucuggggaugccauccugaagaugcuuggaaaauguacucuggagccaacagaauauaaggcggccaaaaauaccuacacggcagagcgauucgucugguugacuaagcucaacaaucugcgcauuuuagaaaacgguagcgagagagcucugaaugccgacgagagggcucuacuccugaaccagcccuaugaaaaagccaaguuuaccuacgagcaggcacggaaacuuuugcagcugaaugaagccgcucgcuucaacuccgugagauacggcaaggagaacgcggaaaagucaacacucauggagaugaaagcauaucaugccaucaggaaggcuguagagacugccgauaguagcgcaugggccacccugaaaacacaaccucuucuguuggacgaaauugggaccgcuuuuucuaucuacaagacggaugaggacauaaaaacucagcuccagggaaagcuggccgauaauguuauugacguguuacuggaaaaccuaaauuucgacaaguuuauccaacucucccugaaagcacuuuauaagauuuugccacugauggagcagggccuccguuacgaugaggcgugcucacagaucuauggugaccacuucgggaaaaaggaacagaaaaacgaucggcuguuaccccaaaucccugcugacgagauucgaaauccagucgugcugagaacacuuagccaggccaggaaggugauaaacgcagucauccgcuuguacggaaguccggcccggauucauaucgaaaccgcuagagagcucggcaagucuuauaaagauaggaaggaaauagagaaacgccaggagcagaaucgagccgaacgggagaaggcaguugacaaauuuaaggaacuguuccccaacuucauuggcgagccuaaggcuaaagauauccuaacuaugcgucuguacgaacaacagaaugggcagugucucuacuccggaaagagccuggaccuucacagauugcuggagaaagguuauguggagaucgaucacgccuuaccauuuucgaggacaugggacgauucuuucaacaauaagguacucgugcuggcgggcgaaaaccagaauaaauccaaccaaacccccuuugaguggcuugggaaggacgaacagaaaugggcccuguucacggcucgcgucaauucaugccgguuuccuuacaguaagaagcagagaauuuugaccaaaaagcucgacgaugagggauucauccagaggaaccugaacgacacacgauauauugcacgcuuucuagugaauuucguuaacgauaaucugcaucucacuggcaaagguaagcggagaguguuugccagcaacgggcaaauaaccgcuuuccugaggggccguuggggacuuacaaaaguccgcgaagaguccgaccggcaccaugccuuggaugcagugguaguugcguguucuacugugagcauccagcagaagauuaccagauuugucaaguaccaagagggcaaucugcagacagccgaaaggaucgaccgagagaccggggaaaucauuccauuacacuuccccgauccgugggccuuuuuccgggaggaggugaugauacgcaucuucucagaaaugccucaggaggaccucgucauuaaacugcccgauagaccacaggcuaaccaugaauuugugcaaccucuuuucguuaguaggaugcccacucggaagauguccggacagggucacauggagacgaucaaaagcgcaaagcgacuggacgaaggcauuucugugucaaaaguaccacuaacacagcucaagcugaaggauuuggagaauauggucaacagagaccgcgagaucgcucuguaugaagccuuaaaagcaaggcucaccgaguuuaaggaugaccccgccaaggcuuucgcggaaccuuuuuacaagaaagggggagugcagguuaagagugugcgugucgagcaagugcagaaaagcggcguagugguucggaaugguaacggggucgccgacaaugcauccauggugagaguggaugucuucauaaaaggcggaaaguauuuucugguuccaaucuacacuuggcaaguggcuaaaggcauucuuccggacagggccgugaucgccuacacccccgaaaacgagugggagcugauggaugacucugcucaguuccaguuuucgauuuauccuaaugauuugaucaagcucacaaccaaaaaggcaauauucuuuggguacuauagcggauucaaccgccugacuggugccauuaauaucaaagaacacgaccuacagauuuccaagggcgauaaggggguacaucugggacuuggcgucaaacucgcgcugucauuggagaaguaccagguggacgaacuggguaaaaacauccgaccaugcagacccacacaacggcagaacguuagguga

SEQ ID NO: 2631 - RNA, 3153 nt, Artificial Sequence
  Cas9 variant
augagcuccuacagauucucuuuugaccugggcaccaacucaaucgggugggccguguucgagcucgaucccaagacaaggccugucgcucuugcagacugcggaguucggauuuuuccagauggucgcaauccgaaagacaagcagagucuggccguggcgcgacgugaagcuagagccguaaggcggcgcagagauagguauuugaaacggcgcagcgaguuaauggaacgacugguggcaaagggccuaaugcccgaguccagagacgaucaaaaagcccucgaagggcuggacccuuacgcucuuagggcagccggacuggaugacgcuuugccaccccaccauuucggccgggcccucuuucaccugaaccagcgucgcgguuucaagucuaauagaaagacugauaggggagagaacucggagacggggauaaccaaaaucggcaugaagaaacugcaugaagcgcucuuaucagagggcugucggacacugggggaacuucagcaccgacaucacgaggcaaaucagacuccugccauggacaccaacccaaagagcguccgcaguaaauugagaggagagggugcuaaggccguguaugauuuuuaccccuccagggacgcaguugaagacgaguucaauaagcugugggauucucaaaaacgguuucacccugaccuacucacagauagcgcucgcgacgccauuagagaugcgaucuucuaucagaggaagcugaaaaccccagacgccggccguugcuccuuuaacccggcagaagaacggguggcucgagccaugcccauugcucagcauuucagaauccuucaguuugucggggaucugagguugauagacaaugaucucgugcgccacccucugaacaaugaccaaaagaaagccuuauaccgggaucugcucgcaaagggaaaacuuacuuucaaggccaugagaaagacaaucggcauugguucagaauaugcuuucagucaugagagcgagaaacagucugaauuucgcggggacgagaccgcggcaaggcuggccggaccaaaguacuucggccccaaauggcgagaauuguccuuuaacgaccagucagagaucguagaucggcuacugcacgaagagaaugaggaaacgcucauucaguaccugcaagaccguuucggcuuugaucacgacagaugugagguuaucgcugaugccccucuuccagacgggcauacuaggcugggaaagaccgcauuggaaacacucguggagauaaugcgcgaugaccaucugcccuaugaucaggccugcacuaaagcugguuacgaacacgccuuaccgccugacggcgucauucuggaugaccuacccuauuacgggaucgcacucgagcggcacguggcguucggagauggcaagagcgagaacccagaaaagagauaugguaaaauugcuaauccuaccgugcauaucgcccugaaccagcuuaggaaggucaucaacgcauugauugcccgauacgggcaccccgaccaaguugugauggagauagcucgcgaccugaaacagaguaaggccaaacgggaugacaucucuaaggaacagaagaaaaaucaggauagaaacgaccaaaggcguaagaaacuccaggaggcacacauugcuguaaaugccgagaacaugcugcgcaugcggcuuugggaggagcuggaugaagacaaugcggccgcuagagcauguccauuuacaggcgagaccaucuccauggccagguuguucagccccgaaguggagauagagcauauucucccuuuuucgcgaucucuggauaacuccccagcuaauaagacguuaugcauggucugggccaaccgggcaaaaggaaaucgcacuccgugggaagcguucggcagagacagggagcccggguuugauuggccugaaaucgccgcucgggccgcacgacugccaaagaacaagucauggagauucggacccgacgcuauggagcgccuagaaagggagggugauuuucucgaccgucagcugacagauacccaguaucuuagucggaucgccagagaguacgugacuaaaauuugugacccuaaucaaguuugggugacaccaggcagguugaccgcauggcugcgccgaaacugggggcucaauggaauccugcccacgggcaacgccaccaagaauagagacgaucaccggcaucacgcuauugacgcgauagucguggguuuaacagauagggggauccugaaccgcguaagccguuccgccgcacuugcugaagccgaggacuuggauagaucuauugccgaaaugccggacccuuucgauggcuuccgggacaacaucaggcacauccucgagcagauuauaguuagccauaaaccagaugcuggauuugugcccggccacccuaaggggaauacuacccccggagcacugcauaacgacacagccuacgguaucauuaaaacugaugcgaagggcaugucagaagucgugacccgcaaagacguccuaaguuucaaggggacaaaggagaucgaguccauucgagacgcugccaccagacagagccugcucgaugcaguggccggaguuccaucuggccuggcuuuuaaagaagcacuucgggacuggucagugaggacugguacgaagcgcguaagagucacauucaauaugagugugaucccuauacaggauagggacgggaaagccuauaagggcuacaaaggagauggcaacuugugcgcggagaucuaugaacggcccgacgggaaguggggagaugagauuaucagccguuuugacgcuguucaaccaggcuucaccccgcaguggcagcgcgaucacccugccgcacaucgagugaugagacuguuuagggacgauaugauuauggccgagaucgacggugucaugacugugugucggauaguaaagaugucccccgggaaagugguuuucaccccacaccacgaagcuaauacagauucucgcaacagagacaaggacgaucccuuuucguuccauaccugcagcggagaguccuuaaggaaacggaaggcccagaaacucuuugucgacccucugggcaagauucgagguuacagagcaaaggaaggcuga

SEQ ID NO: 2632 - RNA, 3153 nt, Artificial Sequence
  Cas9 variant
augggcgagaacaugaucgacgaaagccugaccuucgggauugaucucggaauagguuccugcggcugggccgugcuuagaaggcccucugcuuuugggcggaagggagucaucgagggcauggguucaugguguuucgacguuccugaaacaaguaaagagcgcacuccaacgaaucagauucgacguagcaacagacuguugaggcgggugauccgcagaaggcggaaucgcauggcagccauucgaagauuacugcacgcggcugggcuacucccguccaccgauucugacgcccugaagaggcccggacaugauccuugggaacuucgggcacguggccuggacaaaccauugaagcccguagaguuugccgugguccucggccacaucgcuaaacgcagaggguucaagucggcagccaagaggaaagcuacaaacauaucaagcgaugacaagaaaaugcugacugcccuggaggcgacccgggaacgacucggacgcuacagaacagugggugagauguuugcaagggauccugacuucgccagucggcgcagaaauagggaaggcaaguaugaucguaccacugcucgggacgauuuagagcaugagguucacgcccuguuugcagcucaacgaagacuugggcagggauucgccuccccagaauuggaggaagcguuuacagccucugcauuccaucagaggcccaugcaggacagcgagcgccuggugggcuuuugcccuuucgaacggaccgagaaaagagcugccaagcuaacgccauccuuugagagguuccgccuccuggcucgacuucugaacuugcggaucacuaccccggacggugaacguccccucacagucgaugagauugcccuggugacuagagacuuagggaagaccgcaaaacugucaaucaagaggguacgcacacucauuggacuugaagauaaucaacgguucaccacgaucagaccugaggacgaagauagggacauaguugcccgaacuggcggcgcuaugacagggaccgcgacucugcgcaaagcauugggagaggcccuauggacagauaugcaggagcggccagaacagcuggacgcuauugugcagguccucagcuuuuucgaggccaacgaaaccaucacggagaagcugagagaaauuggucuuacccuggcaguguuggaugugcuccugacagccuuagacgcuggcgucuuugccaaauucaagggggcagcgcacaucagcacuaaagcugccaggaaucugcuaccccaccucgagcaaggacgucgcuacgaugaggcauguaccauggccggcuaugaccaugcugccucucggcugucccaccauggucagaucguugcaaagacacaguuuaacgcucuugugacugaaauuggggagucaauagccaauccuaucgcgagaaaggccuugauugaaggccugaaacagaucugggcuaugaggaaccacuggggacucccaggcagcauacacguagagcuggcacgagacguggggaauaguauugagaagcggcgcgaaaucgagaaacauaucgaaaagaacaccgcccuuagagcuagggagcggcgagaaguccacgaucuguuggaccucgaggaugugaauggagacacacuguuaagauaccgccuguggaaagagcaagguggcaagugccuauauaccgggaaggccauucauaucaggcagauugcagcgacugauaacucuguucagguggaccacauacuccccuggucccguuucggagaugacagcuuuaacaauaaaacgcugugucuugccucggcuaaccaacagaagaaacggucuacaccguacgaaugguuguccggccagaccggugaugccuggaaugcauucguccagagaaucgagacuaacaaggaacugaggggguuuaaaaagcgcaauuaucuccugaagaacgcuaaagaggccgaagagaaguuccgaucaagaaauuuaaacgacacccgguacgcagccaggcuguuugcugaggcggugaaacuuuuguacgccuucggcgaacgccaagagaagggaggcaaucguagaguauuuacacggccuggggcacucaccgcugcccugaggcaggccuggggaguugaaagucugaaaaagcaggaugguaagcgcauuaacgacgaucgacaucacgcucuagacgcacucacuguggccgcggucgacgaggcugaaauccagagacugacaaaaaguuuccacgagugggagcaacagggccuugggcggcccuugaggcgcguggaaccaccuugggaguccuucagagccgaugucgaagcaacguaucccgagguguuuguugccaggccagagcggcgucgcgcucgaggagaaggccaugcagccaccaucagacaggugaaggagagggaaugcacucccauuguauucgagcggaaagcggucucuagccugaaggaagcugacuuagagcgcauaaaagauggugagagaaaugaagccaucguggaggcaauuaggucauggaucgccacagggcggccugcugacgccccaccgcgaagucccagaggcgauauuaucaccaagauacgccucgcaacaacuaucaaagcugccguuccugugaggggaggcaccgcggggcggggagaaaugguccgugccgacguguuuuccaagccaaacagaaggggcaaggaugagugguaccugguacccguguauccucaccagauuaugaaucgcaaagcauggccaaagcccccgaugcggagcaucguugcuaacaaagacgaagaugaguggacggaggucgguccugaacaucaauuccgauuuucucuuuacccaagaucaaauauugagaucauaaggcccaguggggaagugauugagggauauuucgugggccugcaccgcaacaccggugccuugacaaucagcgcucacaacgacccuaaguccauucauucuggcaucgggacuaaaacccuccuggcaauaucgaaguaccaggucgaucgguuuggaagaaagagccccguucguaaagaagugaggacauggcacggcgaggccuguaucuccccaacuccucccggguga

SEQ ID NO: 2633 - RNA, 3153 nt, Artificial Sequence
  Cas9 variant
augaagauccugggcuucgacauugggauagccagcaucggaugggcuuuuguggagaacggugaacucaaagauugcggcgucagaauuuucaccaaggcagagaaucccaaaacaggggacucccuugccaugccuaggcgggaagcgcgcucuguucgacguagacuggcuaggcggaagggacgcuuggagacuuuaaaaagacugcuagccaaggaaugggaucucuguuacgaggacuauaucgcagccgauggcgagcugccaaaggcuuuuauggguaaaaaccuuaauaacccguacgugcugagguaugaagcauugcagcggcuccugucaaaggaggaacugguacgcgugguccuccacauugccaaacaucgaggguacggaaauaagaacgcuaaaaucacgaagagugaggagagcaagagagaacaaggcaaaauauuauccgcccuggcgaccaaugcaucugccaucgcuagguaucggacagugggcgaguacuucuauaaggaauuuugcgagguuauuaaaaacccccaggggcuuucgacuaaugaacacuacacccagucaaaggugcgugucuugaaaccuauccgcaacaagggaggugaguacacaaauuguauucugcaggaggaccuacaaagagaacucaggugcaucuucgaguaucagaaaggcuuuggguucccaauaacccaggaauuucaggauaagauucugaagaucgccuucuaccaacggccccuuaaagacuuuagccaucuggugggaaaguguacuuucuauccugaugaguuucgagcauugaaaugcagucucuccgcuguagaguucauuacacugucuaagaccaucaacguuuuaacguacaucagcaaagaauccggcgagguguauucaaagggucaguacgaacagaugcuggacagugucuucaaggccgugugugagaaagggagccucucuuuugcgcagcuucgcaagauucugcacauagaugaaagaaucagguucaaagagguggacuauauggcccggaaguccaaaaauacuucaggagauagcacccauaagcaaaagacaaguaacccagaaacuaaaaaguuuauugagcacaaaaauuugaagaaauucugcgagauccuaucugaaauagcagaggaccgcgcucuggccgacuccauugcuagagauaugacccucaucaaggacgaagagaagcuggcccagaaacuucacggcuacggcaaguuuagccaggagcaaaucacacagcugucggcauugaacuucucucaucacauuaaccucucccugaaagccuuaucagaaauccugcccuuuaugagggaggggaugcguuacgaugaggcuuguaagcuagcgggacucaaagcacggcauaaugacaagaaaaguaaguuccugccuccauuuugcgaaagcauuuaugccgaugaacuuaccaacccggucguucaccgagcuauagccgaguacagaaagaucuugaaugcacugauugccaaauaugguuccgugcacaagauccauaucgagcucacgagggacguaggcaaaaacuuccaggaacgcgagaaguacaaaaaggaaauugagucuaauuauaaggcucgggugcaggccaugcaagaaugugagaaacuggggcuuacucugagcgagggaaacauauugaagcucagacuguuuagggaacagaaugagaucugcgucuacucaggccgcaaaauuacauuagcaaaccugaaggaacagggugcgcuagagaucgaucacauucuccccuauagucgauccagcgacgauucuuacaugaauaaagugcugguuuucaccaacgaaaaucagaacaaggggaauaagacuccuuacgaggcuuuuggcggagacucacaaaaauggggcgagaucgaaagucuugccuugcggagcggguauccaaagaaaaaggcaaaacguauacuggauaagggauucggugacagagaggccggcuucaaguccaggaacaucguggacucuggguacauugcucgccucaucgccaauuauacaaaagaauaccugaaguuuuuaccccuggauucgcaugagaacaccgcacuuauugcuggagagaaagacagcaagauccacgucgaagccgugaaaggcauguugacggcgaccaugcggcauuucuggggucucggguccaagaacagauaugagcacacacaccaugccguagaugcuauaauuaucgcauacauuaaugccgcuaugauccagagguuuucacaguuccgacagaaccaagaaagucugaaagcccgcuuuuaugcaaaggagcuagcgaaggaagaguucaaaacucagcgggccuuuuucgagccuuuuagaggcuucagggaacagguucuggcuaaggugggacagauauuugucucucguccaccccgcaaacgggccagaggcgcacuccacgaggaaaccuucuacagcaucgacgauaagaaacuguccgagacauacgggggaaaggaaggugugcaaagggcucuuucauugggcaagauucgacagaucgggacuaaaauugucgccaauggaccgauggugcggguugacaucuuuaagcauaaacagagccgcagauucuaugcagugccuauauacaccauggauuucgcccugggcauuuuacccaacaaggcuguagucucugguaaagacacaaaguccaaggugaucaaagauuggcucgagauggacaguugcuaugaguuuuguuucagccuguuuaaggaugaccuuaucgaaguucaaaaaucugauauggagaagccagaacuggcguacuucguguccuuggacgccucagacgggaggauuaaaguccggcaccacugcaaugauaucaccaagauuaacgagaaucagaagaaacucuuuagugaagcaauagagaaggaggugguaggccgaggaagcauccagaaccugaaaguguucaagaaauauaagguuucgccucuaggcgaaauuaaggaggcuaaauacgaacccagacagccaaucgcccugaagacuucccccaaaaagcaucgcaaacaaaauaacgcccaguga

SEQ ID NO: 2634 - RNA, 3156 nt, Artificial Sequence
  Cas9 variant
augaacaauuacauccugggccucgacauugggauaaccagcgugggauaugguaucgucgauuccgacacaagagagauuaaggaugccggcguuaggcuuuuccccgaagcuaacguggacaauaacgaggggcggcgcucuaaacgaggagcacguagacugaagaggcggcgcauccacagauuggauaggguaaaacauuuacuggccgaauacgaccuacucgaucugacuaauauuccuaagucaacgaacccauaucagacccgggugaaaggccuuaaugagaagcugaguaaggacgaauuggucaucgcgcuccugcacauagcuaaacgccgagguauccauaacgugaauguuaugauggaugacaacgauagcgggaaugagcuguccacaaaggaccaacucaaaaagaacgccaaagcauuaucugauaaguacgugugcgagcugcagcuugaaagauuugagcaggacuauaaggucaggggagagaaaaaucgguucaagacugaagacuuugugcgugaggcccgcaaauugcuggaaacccagucgaaguucuuugagauugaucaaacauucaucaugagauacauugaacuaaucgagaccaggcgggaauauuuugagggcccgggcaaagggucacccuucggaugggaggguaacauaaagaaaugguuugaacagaugaugggccacuguacuuacuucccugaggaacuccgaagcguaaaguacaguuauuccgcugagcuguuuaaugcacuuaacgaccugaacaauuugguuauuacacgcgaugaagacgccaagcucaacuacggggagaaauuccagaucauugagaauguguuuaagcagaaaaagaccccaaaccugaaacaaaucgcuaucgaaauuggaguccaugagacggaaauaaagggcuauagagugaauaagucugguaaacccgaguucacucaguucaaguuauaccacgaucugaaaaacaucuuuaaggacccuaaauaucucaaugauauucagcuuauggacaacaucgccgaaauaauuaccaucuaccaggaugcggagagcaucauuaaggagcugaaucaauugccagaacuacuguccgagagggaaaaggagaaaaucucagcacucaguggguauagcggaacacaccggcugucucuuaagugcauuaaccuguugcucgacgaucugugggaguccucauuaaaucagauggaacuguucacuaaacuaaaccucaagcccaaaaagauagaccugagccagcaacauaagaucccuaguaaacuuguggacgauuuuauuuugucuccagucguuaagcgcgccuucauccaguccauccaggugguaaaugcuauuauagacaaauacggccugccggaggauaucauuaucgaacucgccagagagaacaauagcgacgauaggcguaaguuucugaaccagcuucaaaaacagaacgaagagacccggaaacagguggagaaaguccugcgagaauacggcaaugacaacgcaaagagaauugugcagaagaucaaauugcacaauaugcaagaggggaagugucucuauucgcugaaagauauacccuuagaagaccugcuaaggaacccucaucacuacgagguugaucacaucauuccacgcucuguggcuuucgacaauuccaugcauaacaagguccucgugcgggccgaugaaaauucaaagaagggaaacagaacacccuaucaguaccugaauaguagcgaguccucucuuagcuauaacgaguuuaagcagcacaucuugaaucugucaaaaaccaaggacaggauuacgaaaaagaaacgcgaauaccuccuggaggaacgagauaucaacaaguucgacguacagaaggaguuuauaaaucggaacuuaguugacacucguuaugcgacaagagaacugaccagucuuuugaaagccuacuucuccgcaaauaaccucgaugugaaggucaaaacuauuaacgguagcuuuacaaauuaccugaggaagguguggaaauucgacaaggaucgcaacaagggcuauaaacaucacgcugaggacgcccuaaucauugcuaaugccgauuuucuguucaagcauaacaaaaagcuccggaauaucaacaaaguccuggacgcaccuucuaaggagguggauaaaaagagaguuaccgugcaaucagaagacgaguacaaucagauauucgaagauacgcagaaggcccaggcuaucaaaaaguuugagauuaggaaauucagucaccgaguagacaagaaaccaaaccgccaacuuaucaaugauaccuuguauagcacacggaacauugacgggaucgaguacgucguggaauccauaaaggauauuuauucuguuaauaacgacaaggugaaaacuaaguuuaaaaaggacccccacagacuguuaauguacaggaaugauccgcagaccuucgagaaauuugaaaaggucuucaagcaguaugagucggagaaaaacccuuuugcgaaguacuacgaagagacaggagagaaaauccguaaguucagcaaaacuggccaaggucccuauaucaauaagauuaaguaccuccgcgaacggcuggggagacauugcgacgugaccaacaaauauaucaacuccaggaauaagauuguacagcuuaaaauauacucauaucgauuugauaucuaccaguauggcaacaauuacaagaugauuacaaucaguuacauugaccuggaacagaaaucuaacuauuacuauaucagccgggagaaguacgaacaaaagaaaaaggauaaacagauagacgauuccuauaaguucaucggaucauuuuacaaaaaugacauuaucaacuauaauggcgagauguaccgcgugauugggguuaacgauagcgagaagaauaaaauccaguuggacaugauagauauuucuaucaaggacuacauggaacucaacaauaucaagaaaaccggagucauuuauaagacuauagguaaauccacgacacacaucgagaaguacaccacugacauucugggcaaccuauauaaagcagccccaccuaagaagccccagcugaucuucaaauga

SEQ ID NO: 2635 - RNA, 3159 nt, Artificial Sequence
  Cas9 variant
auggagaacaagaaucugcacuacauccucggccuugaccuggggauugccagcgugggaugggcugucguugaaauagaugagaaagaaaaccccuugagauuaaucgacguggguguaaggaccuucgagcgggcagaaacacagaagggcgagucccuggcccuaucucgccgaucagcgcguagugcuagaaggcucacucaacggcgcguggccagacugaaaaaggcaaaaaggcuucuuaagagcgagaauauuuugcucuccacggaugaacggcugccucaucaggucuggcagcugcgcguggaggggcucgaccgaaaguuagaaagacaggagugggccgcuguucugcuucacuugaucaaacauaggggauaucugucucaacggaagaacgagucgaaaucagaaaauaaggagcuaggcgcacuccugagcgguguggccaguaaccacgaacuucugcagcaggcuaccuaccguacaccagccgaguuggcggucaaaaaguuugaaguggaggaggggcauauucgcaaucagcaaggagcauauacucacaccuucuccagacucgaucuguuagccgaaauggagcugcucuuuucuaggcagcagcacuucggcaacccguuugcuagcgaaaagcugcuggagaauuugacagcccuacugauguggcagaaacccgcacucuccggcgaagacauccugaagaugcuugggaaaugcaccuucgaggaugaguacaaggcugccaaaaacacuuauacagcggaacgguuuguauggauaaccaagcugaauaacuugcgaauccaagagaauggacucgaacgcgcccugucagacaacgagagauuaaugcugauugaacagccuuacgagaaagcaaagcuaacguaugcucagguuaggaguauccucaaucugagcgaugacgccauuuucaagggugugcgguacucuggcgaggauaaaaaggcuaucgaaacuaaaaccacacuuauggagaugaaggccuaccaucaaauacgcaaagucuuggaagggaacaaccugaaggcagaguggguggcccucaaggcuaauccaacucugcuugacgagauuggaaccgcguuuucccuguauaaaacagaugaagacaucucagcauacuuggccggcaagcucagccagcccgugcugaacgcuuuacuggagaaucuaaguuucgacaaauuuauucagcucucucugaaggcccuuuauaaauugcugccucucaugcagcaaggucugagauacgaugaagcauguagggagaucuauggggaccacuacggaaagaagaccgaagagacgcaucacuucuuaccacagauccccgccgaugagauucguaacccugucguucugcggacucuuacacaggcucgaaaagugauaaauggcguagugagauuguauggcuccccagccaggauccacauugaaaccgggcgcgaggucggaaagagcuacaaagaccggcaugaacucaagaaaagacaggaggaaaacaggaagcaacgcgagaagacuaucucggagauaaaaacacuguuuccgaauuucucuggugaacccaagggcaaagauauucuaaagaugcgacuguacuaucagcagaacgcaaaaugccucuacuccgggaagccucuggagcuucaccgguuguucgaacagaaauauguggagguugaccaugcgcugccauuaucacguaccugggaugacaguuuuaauaacaaggugcucguccuggcuaaugaaaaccaaaauaagggaaaccuuacgcccuucgaguggcuggauggcaaaaauaacagcgagagauggaggaccuuuaaggccuugguggaaacauccgcauucccuuacgccaaaaagcagcgcauccucucucagaaacuggacgagaaggguuuuaucgaacggaaccuaaaugauacuagauauguagcuagguuccuguguaacuuuauugccgacaauaugcaccucaccggggagggcaagcgaaaaguuuucgcaagcaacggacagaucacagcucugcuucgccggagauggggcuuggccaagucaagggaggacaaugaucgucaucacgcgcuggacgccguguuagucgcuugcaguacuguggcaaugcaacagaaaauuacccgcuuuguccgguucaaggccggggauguguuuacaggagaaagaauagacagggagaccggugaaaucauuccacuccacuuccccacuccguggcaguuuuucaaacaagagguugaaauccgaaucuucuccgauaacccuaagcuggagcuugagaaucggcugcccgaccgcccacaggcuaaccaugaauuugugcagccucuauucguaagcagaaugcccacgaggaagaugacaggccaggggcacauggagaccgucaaaucugccaagcggcucaaugaaggaauuucaaugauaaaaaugccacugacuaaguugaaacugaaggauuuagagcucauggugaaccgagaaagagagaaggaccuguacgaugcacuuaaaacccgccuggaggcguuuaaugacgaucccgccaaggcuuucgccgaaccuuuuaugaaaaagggcggugcaaucguuaaaagugugagggucgagcaagugcaaaagagcgggguauuggugcgucagggcaacggaguugcugacaaugccuccaugguccggguggauguguucacaaaagacggcaaguauuuucucgucccaauuuacaccuggcagguugcaaaggggauccugccgaacaaagccgugauucagggaaaggacgaagaggauugggaagacaucgaugacgcuacuuuccaguuuucucuacaucccaaugaucugauaucggugaaaacaaagaaagacgaguuccuugguuacuuuaacggccucaacagacacaccgggggaaucaauauuaggacgcacgaucuggaaaagagcaagggcaaacaggguaucuucgaggggauuggcguaaagaucgcguuguccuuugagaaauaucagauagacgaacugggaaagaacauucgcuuauguaaaccuucaaagcgacaaccagucagauga

SEQ ID NO: 2636 - RNA, 3159 nt, Artificial Sequence
  Cas9 variant
augaagaacaccagccugaauuacgugcucggccuugaccuggggaucuccucugucggaugggccguuguggagauugaugaaaaagagaaccccuugucauuaauagacguaggugugagaacauucgaaagggcugagacucagaagggcgaaagucuggcacuagcccggcgccucgcgcgaagcgcucguagacugacgcaaaggcgggucgcccgccuuaaaaaggcaaaaagacuguugaaguccgagaauauccuccugucuaccgaugagugccugccucaccagguguggcagcucaggguugaaggguuagagcggaagcuggaacgccaggagugggccgcugugcuuuugcaucugauuaaacaccgaggauaucuaucgcaaagaaagaacgagucaaaaagcgaaaauaaggagcucggcgcacugcuuaguggugucgccaacaaucauaaacuguugcagcagacaacuuacaggaccccagcugaacucgccgugaagaaguuugagguagaagaggggcacauccggaaccagcaaggauccuauacacauaccuucucucgucuggacuuacugagcgagauggaacuccuguuuucccgccagcagcacuucggcaauccguuuacuucagagaaacuuuuggaaaaccuaacagcgcugcucauguggcagaagcccgcacugaguggcgaugccauucuuaaaaugcuggggaaguguaccuucgagaaugaauacaaagcugccaagcacacguauagcgcagagagauuuaucuggauaacuaaauugaacaaucucaggauccaagagaacggacuggaacgggcuuuaaaugacaacgagcgacuggcccuaaugaagcagccuuacgaaaaggcgaaacucaccuaugcccagguucgcucuauucugaaccuuuccgaugaggcaaucuucaaggguuugagauacucaggcgaagacaaaaagacaagcgagacuaaaaccgugcugauggagaugaaggcuuaccaucaaauuaggcucgcccuggaaaagaaugaucuuaaaacagagugggcugaacugaaggucaacaguucuuugcucgacgagaucgggaccgccuuuucccuguauaaaacggaugaggacauaagcacuugcuuagcaggaaagcugucgcagccagugcuaaaugcccuccuggaaaaccuuaauuucgauaaauuuauucaguugucucugaaggcucuccacaagauccugcccuuaaugcagcaaggccugcgguacgacgaggcgugugcagaaauuuauggugaccauuacgggaaaaagacagaggaaaaccaccuuuugcucccucagaucccagccgaugagauccgcaaucccgugguccugagaacccuaacucaggcuaggaaaguuauuaacggagugguacgucuguauuccaguccugcccggauacacaucgagacaggccgagaagugggcaagucauaccaggacagaagggagcucgaaaaacgccaagaggaaaaucggaagcagagagagaaggcaauuagcgagaucaaaacccuguucccaaacuuuuccggggaaccgaaggccaaagauauacuuaagaugagguuguauuaccagcagaaugcuaaaugccuguacucuggaaagcccuuagagcuccaucgccugcuugaacaagguuaugucgagauugaccacgcccugccuuucagccgaacgugggaugacucauucaacaauaaaguguugguucucgcaaacgaaaaucagaacaagggcaaccugaccccauuugaguggcuagaugggaagaauaacagugagcgguggaaagcguucaaggcucugguggaaacauccgccuuucccuacacuaaaaagcagcguauccucagccagaaacuggacgagaagggauucaucgaaagaaaucuuaacgauaccagguaugucgcacgcuuuuuguguaauuucauugccgacaacaugcaucugacaggcgaggguaagcggaaaguguuugcuucuaaugggcaaaucacugccuuacucagaggaagguggggccuggcaaagucacgagaggauaacgaccgccaccaugcucuugacgccguaguuguggcgugcaguaccgucagcaugcagcagaaaauuacacgguucgugagauuugaagagggcaaugucuucaccggggaaaggauagaucgugagacuggagaaaucauuccucugcacuuuccagcccccuggaaguucuuucgcgaggagguggaaauccggaucuucuccgacaacccgaaacuagagcucgaaaauagacugauugcuaggccucaagcaaaccacgaguucguucagcccuuguuugugucucgaaugccaacgcggaagaugacaggucagggccauauggaaaccauaaagucggccaaacgccugaaugagggguuaagcguaaucaagaugcuccugacuaaacuuagacugaaggauuuggaguccauggucaacagggaacgggagaaagaacucuacgaggcucugaaggcccgacuagaagcauucaaugacgagccugcgaaggccuuugcugagcccuucaugaaaaagggaggcgccauugugaaaucaguuagaguggaacagguccaaaagaguggugugcugguacgcgaugggaacggcguggcagacaacgcuucuaugguuagggucgauguguuuaccaaaggaggcaaguauuuccuugugccaaucuacacauggcaggucgccaaagggauucuccccaauaaggcaguuauccagggaaagaacgaggaagacugggaggugauggaugacgccaccuuucguuucagccugcaccagaaugauuuggugaaacugguaacuaagaaaaagacaauauuugguuauuucaacggcuuaaaucgggcuacggggaacaucgacauuaaagagcaugaucucgaaaaguccaaggucaaagacggaauccaccaaucaauuggcaucaagcuggcgcuuagcuuugagaaauaccagguggacgaacuggguaagaauauaagauuguguaaaucuuccaagaggcaggccguucgcuga

SEQ ID NO: 2637 - RNA, 3159 nt, Artificial Sequence
  Cas9 variant
augaucggcgagcacgugagagggggaugccuguucgacgaucauuggacccccaacuggggugccuuuaggcucccuaauacaguccggacuuucacgaaggcugaaaacccaaaagacggcagcucccuugcagagccgcgccgacaggcccgugggcugagaaggcgguugcgcagaaagacccaaagguuagaagaucugcggcgccuacucgcgaaagagggaguucugucucuuucagaccuggaaacauuguuucgagagacucccgcuaaggauccuuaccagcucagagccgagggccuggacaggccacugaguuuccccgaaugggugcggguacucuaucacauuaccaaacaucgugguuuucagagcaaucgcagaaacccuguggaggaugggcaggaaaggucccggcaagaggaggaaggaaaguuacugucuggcgucggcgagaaugaacgacuuuugcgcgaagggggauacagaacagccggugaaaugcuggccagggacccaaaguuccaggaucaccggcgcaacagagcuggcgacuauucgcauacccuaucaaggagccuccugcuugaggaggcacgucggcuguuucagagucagcgaacuuuggggaauccccacgccuccucuaaccucgaagaggcuuuccugcacuuaguggccuuucaaaauccuuucgcgagcggagaagauauaagaaacaaagcaggccauuguucccuggagccagaccagaucagggccccgcgccggucagcuagugccgaaacauuuaugcuccuucagaagaccgguaaucugagauugauucacaggcgcacgggggaggagcgaccccuaacugauaaagaacgggagcagauccaucugcucgcauggaagcaagaaaaaguuacccacaagacacugcguagacaccuugagauuccugaagaguggcuguucacuggauugccauaccauaggagcggcgacaaggcugaggaaaaacucuuugugcaccuggccggcauccaugagauacgcaaggcguuagacaaagggcccgauccugccgucugggacacccugcggucuagaagggaucuacucgacuccaucgcagauacacugaccuucuauaagaacgaagacgagauucuuccacgauuggagucacugggacucagccccgaaaaugcucgcgcccuggcuccgcuuaguuucucugguacggcccaccuguccuugagcgcacucggcaaacuguuaccucaucuggaggaagggaagucguacacucaggcccgggcugaugcgggauaugcagcacccccaccugacagacaccccaaacuaccaccccucgaggaagcugauuggaggaacccugugguauuucgugcccugacacagacccgcaagguugugaaugcacuuguccggagauacggcccaccguggugcauccacuuggagacugccagggagcugucucaacccgcuaaggugcgacggcgcauugaaacagagcagcaggccaacgagaaaaagaaacagcaagcagagagagaauuucucgacaucguggguaccgcgccugggccaggcgaucuguuaaagaugaggcuguggcgggagcagggaggcuuuugucccuacugcgaggaauaucuuaacccuacgcgauuggcugagccaggguacgccgaaauggaccauauacuccccuauuccagaucacuggacaauggauggcacaaccgcguccuaguucaugguaaagauaauagggacaagggcaaccguaccccguucgaggcauuugggggagauacagcccggugggacagacugguggcuuggguacaggccagucaccucagcgcaccuaagaaaaggaaucugcuucgcgaagauuucggcgaggaggcugaacgagaguugaaggacagaaaccugacugauacccgguuuauuacaaaaacugccgcgaccuuacucagggaccgccugacauuccacccagaagcccccaaggauccugugaugacccuuaauggucgucugacugcuuucuugagaaaacagugggggcuccauaagaaccggaagaauggcgaccugcaccaugcacuagaugccgcuguccuggccguggcauccaggucuuucguuuaccgccucagcucacacaacgcggccuggggagagcugccccgaggcagagaggcugaaaauggguuuagucuuccauauccugccuuccgguccgagguguuggcaaggcugugucccacgcgcgaagagaucuuacucagacuggaccaaggaggugucggcuacgaugaggcuuuuaggaacgggcuucggccaguguucguaagccgugccccgucucgccgacugagaggaaaagcacauauggaaacacuaaggucaccuaaguggaaagaccaccccgagggcccacggaccgccagucgcauuccccucaaggaccugaauuuggaaaaacuggagagaaugguugguaaggauagggaccggaaguuauaugaagcucuccgagagagacuggcggccuucgggggcaacggcaaaaaggcauuuguggcuccuuuccgcaaaccaugcaggagcggagaagggccccuuguccggucccugcguaucuuugauucuggauacucgggcguggaguugagagacgguggggaggucuacgccguggccgaucacgaaagcaugguuaggguggacguauaugcuaagaaaaaucgcuucuaccucgucccuguguauguugcagauguggcccggggaaucgucaagaaccgagcgauuguggcucauaaauccgaggaagagugggaccugguagauggcucauuugacuucagauuuagucuauucccgggugaucugguggaaauagagaagaaggacggcgccuaccuuggguauuacaaaucuugucacaggggagauggccgccuccuguuggaccggcaugacagaaugccacgugagagcgauugcgggacuuuuuauguuuccaccaggaaggacguccugucaaugagcaaauaccagguggaucccuuaggagaaauccggcucgugggcucugagaagccuccauucguccuguga

SEQ ID NO: 2638 - RNA, 3162 nt, Artificial Sequence; identical to SEQ ID NO: 2542
  Cas9 variant

SEQ ID NO: 2639 - RNA, 3162 nt, Artificial Sequence
  Cas9 variant
augaagagaaacuacauccugggccucgacauugggauaaccagcgugggauaugguaucauugauuacgagacaaggaaugucaucgacgccggcguucggcuuuucaaagaagcuaacguggagaauaacgaagggcgccgauccaagcguggaacuagaaggcugaaacggcgcagaaggcaccgguugcagcgcguaaagaaauuacuguuugaucauaauuuccuaacggacaacucugagcucucaggcauuagucccuaugaagcacgagugaagggucugaaucaaaagaucagcgaggaggaauuuuccgucgcccuucugcacuuggcgaaaagaaggggagugcauaacguuaaugagguggaagaggauaccgggaacgagcucucuacaaaggaacagauaucgcguaauucaaaagcucuggaggaaaaguacgucgccgagcugcagcucgaacgguuaaaaguggacggcgagguacgcggcgcaguuaacagauucaagacuagcgauuaugugaaggaggcccagcaaauccugaaaguccagaaggcuuaccaccaguuugaccagaguuucauugauaccuauaucgaccuuuuggaaacaaggcggaccuacuacgaggggccuggagaagguuccccauuuggcuggaaagauauuaaggagugguaugaaaugcugauggggcaaugcacuuacuucccggaggagcuacgaucugugaaauaugcauacaaugccgaccucuauaacgcucugaaugaucuuaacaaccuggugaucgcccgcgacgaaaaugagaaguuggaauacuaugagaaauuucagauaauugaaaacgucuucaagcagaagaaaaagcccacacucaaacagaucgcgaaggagauucugguuaaugaggaagacaucaaaggauacagagugaccagcacgggcaagccugaguuuacuaacuucaagguauaccaugauaucaaauccauuaccucaaggaaggaaauauuagagaaugcagagcugcucaaccaaaucgccaaaauucuuacaaucuaucagaguagcgaagacauacagggugagcuggcucgguuguacucugaacuaacucaagaggaaauugagcagaucuccaagcuggccggguauaccggaacacaccgccucucacugaaagcaaucaaucuuauuaucgaugagcuguggcacaccagcgacaaccagauggaaauuuuuaauagauugaagcucgugccaaagaaagucgaucugagucagcaaaaggagauacccacgacuuuaguggacgauuucauccugucuccuguugugaaaagguccuucauucagagcaucaaggucaucaacgcuauuauaaagaaguacggcuuuccaaaugacaucauuaucgaacuagcccgugagaagaacucgaaagaugcgcagaaguucauuaaugaaaugcagaaacggaaccgacaaacaaaugagagaaucgaggaaauaaucaggaccacuggcaaggagaacgccaaauaucucauugaaaagaucaaacugcaugacaugcaggaggggaagugucuuuacucuuuggaagcaauuccccuggaggaucuccugaacaauccuuuuaacuaugagguggaccacaucauaccacgcuccguaucauucgacaauaguuuuaacaauaagguucuugugaaacaggaagagaacagcaagaaaggaaaucggacaccguuccaguacuuuuccucuagcgauucaaagauuaguuacgaaaucuucaaaaagcauauucugaacuuggcuaaggguaaaggcagaaucuccaagaaaaagaaagaguaucuccuggaggaaagggacauaaaucgcuuuagcguccaaaaguacuucaucaaccgaaauuuaguggauacccgguaugccacgcgugagcugaugaaccuacucagaucuuacuuuagggucaaugaccuggauauuaaggugaaaucaaucaacgggggauucaccaguuuucuucgcaagaaauggaaguucaaaaaggaacggaauaagggcuauaaacaccacgcugaggacgccuugauuaucgcaaacgccgauuucauauuuaaggaauggaaaaagcuggacaaaacaaacaagguuauggaggaucagauuguggaggaacagcaggcugagagcaugcccgaaaucgagacugaacaagaguacaaagagaucuucauuaccccucaucagauccaggacauuaaggauuuuaaggacuauaaauacucccacagaguagauaagaaaccaaauagggaacucgucaacgacacacuguacucuacucgaaaggacgauaaagguaauaccuuaauagugaacaaucugaaggggcuuuaugacaaggauaacgacaaauugaagaaacucaucaauaagucgcccgagaaacugcuaauguaccaucacgauccucaaacauaucagaagcugaagguuauuauggaacaguacagcaacgagaaaaauccacucuauaaguaccaugaagagaccggcaacuaucugacuaaauacuccaagaaagacaauggacccgugaucaagaagauuaaauacuauggcaacaaacuuaaugucuacuuggauaucacgcgcgacuaucugaaaucacggaacaagauagugaaauuaagucucaagccguacagauucgauguauaucuggacaaugggguguacaaguuuguuacagucaaaaaccuugauaucauuaagaaagaggacuauuacgaaguggauucugacagcuacgaggaagcgaagaucgugaaaaaggucuccgagcaggcacaauucguugccucauuuuauaacaaugaccugauuaaaguggauggagaguuguucagggugaucgguguaaacaaugaccuccugaaccguauagaagucaauaugguggauauuaccuacaaggaguaucuagaaaacaucaaugacaagaaaagcucucgcaucauuaagacuauauccaguaaaacccagagcaucaagaaauacucuacagauauucugggcaaccucuaugaggcuaaguccaagcagcggccucagaugaccaugaaaggguga

SEQ ID NO: 2640 - RNA, 3162 nt, Artificial Sequence
  Cas9 variant
augaagagaaacuacauccugggccucgacauugggauaaccagcgugggauaugguaucauugauuacgagacaagggacgucaucgaugccggcguucggcuuuucaaagaagcuaauguggagaacaaugaagggcgccgauccaagcguggagcaggcagacugaaaaggcggcgcagacacagguugcagcggguaaagaaauuacuguuugacuauaaccuacucacugaucauucugagcugucagguauuaaucccuacgaagcccgcgugaaggggcuuagucaaaagcugagcgaggaggaguucuccgcggcuuugcuccaccuggccaaacgaagaggaguccauaacgugaaugaaguugaagaggacacgggcaacgagcugucuaccaaggaacagaucucgaggaauaguaaagcacucgaggaaaaguauguggccgaguuacagcuggaacggcuuaaaacagauggcgagguccgugggagcauaaaccgcuuuaagacuucagacuacgugaaggaggcuaaacaguugcugaagguacaaaaagaauaucaccagcuagaucaguccuucaucgacaccuacauugaucuccuggagacaagaaggaccuacuaugaaggaccuggugagggcucuccauuuggguggaaggacaucaaagaaugguacgagaugcuuaugggacauugcacuuauuucccggaggaacugcggagcguuaaguacgcauauaaugccgauuuguacaacgcucucaaugaccugaacaauuuagugauugcccgagacgagaacgaaaaacuggaguauuacgaaaaguuucagaucauagagaacgucuucaagcaaaagaagaaacccacacucaagcagauugagaaagaaauccuugugaaugaggaagauauuaagggcuaccgcgugaccuccacggguaagccugaguuuucaaaccugaaagucuaucacgacaucaaggauaucacugcgagaaaagagauuauagaaaaugcagaguugcuagaccagaucgccgaaauucugaccaucuaccagaguagcgaggauauacaagaggaacucguuaagcugaacucugagcuuacacaggaagagauugaacagaucuccaaucugaaaggguauacuggaacccacaacuugucacucaaggcuaucaaucugauuuuagacgagcuguggcauacaaacgauaaucaaauggccaucuucaacaggcuaaagcucgugcccaaaaagguagaccugagccagcagaaagaaauuccaaccacgcuuguggaugacuuuauauugaguccugucgugaagcggucuuucauccaguccauuaaaguuaucaaugcaaucauuaagaaguacggccugccaaacgauauaaucauugagcucgcucgcgagaaaaauagcaaggacgcccagaaaaugaucaacgaaaugcaaaagagaaauaggcagacuaacgagcguauugaagagaucauacggacaaccggcaaagaaaacgcgaaguaucugaucgagaaaauuaaacuucacgacaugcaggaggggaagugucuguacucguuggaagccaucccccucgaggaucuguuaaauaacccuuuuaauuaugaaguggaccauauuaucccacgaucugucuccuucgauaacucauucaauaacaaagugcugguaaagcaagaggagaauaguaaaaagggaaacagaacuccguuucaguaccuaagcuccucugacagcaaaauaucauacgaaacauucaagaagcacauucucaaucuggcaaaagguaagggcaggaucaguaaaaccaagaaagaguaucuuuuggaggaacgcgauauuaaccgguuuuccguucagaaggacuucaucaauagaaaccugguggauacgagguacgcuacccgcgaacucaugaaucuguuacgaagcuauuuucgggucaacaaucuggacgugaaggucaaaucuauaaacgggggauucacaucauuucuucguagaaaguggaaauucaagaaagagaggaacaagggcuacaagcaccaugccgaggaugcuuugaucauugccaaugcagacuuuaucuucaaagaauggaagaaacucgauaaggccaaaaaggugauggagaaccagacuguugaagagaaacaagcugaaaguaugagcgagauugagaccgaacaggaguauaaggaaaucuuuauaacaccccaccagauucagcauaucaaggacuucaaagauuacaaguauucccaccgcguggacaaaaagccuaaucgggagcugaucaacgacacucuauacucuaccagaaaagaugacaaggguaauacacugauuguaaacaaucucaacgggcuguaccauaaggauaaugacaaacuuaagaaauugaugaacaagucgccagaaaaacuguuaauguaucaccacgauccccaaaccuaccagaagcucaagcugaucauggagcaguauggcgacgagaaaaauccucuuuacaaguauuacgaagagacuggaaacuaucugacgaaauacagcaagaaagauaauggcccagucauuaagaagauaaaauacuaugggaacaaguugaaugcgcaucucgacaucacagaugacuaccccaacuccaggaacaaagugguuaagcugucacuaaaaccguaucgauuugauguguaccuggacaauggagucuauaaguucgugaccguaaagaaccucaaugugauuaaaaaggaaaacuacuaugagguuaauaguaaaugcuacgagaaggccaaaaagcugaaaaagaucucugaucaagcagaguucauugcuagcuuuuacaacaaugaccuuaucaagauagacggugaauuguaucgcgucaucggcgugaacacugaucugauuaaucggaucgaagugaacauggucgacauuaccuacagagaguauuuagaaaauaugaacgauaaaagguccccucguaucuucaagacaauagccucaaaaacccagagcauuaagaaauacucuacugacauccucgggacacuguaugagguuaauuccaagaagcacccccagaugaucaugaaaggauga

SEQ ID NO: 2641 - RNA, 3162 nt, Artificial Sequence
  Cas9 variant
augagcggcaugguguucgggaucgaccugggaauugccuccugcgguugggcuguccucagacagccccaaagggauggcgacccuggggagauaguugaucuuggaucuuggauguuugacgugccagaaaccgauaaggagcggacaccgacuaaccagguacgccgaggcaaucgucuguugagaagggugauccggcgcagagcacagaggauggucgaaauucggcgcuuauuccacgaccauggucugcuagccgggcacgcgcccgaggcucucaaacgagccggacuggauccuugggaccuuagagcaaggucacuggauaagguguuggaaccagccgcucucgcaguugcccugggccauaucgcuaaacggcguggcuuuaagagugccgcgcgcagaaaagaggcaaacacggccggggacgaucagaagaugcugaaggcucucgaggccacccacgaaagguuaggacgguaccgaacaauuggugagauguucgcacgcgaccccgauuuugaaagcagaaaaaggaaucgggacggcauguucgaccgcacucaagggagagaugaccugcuucaugaggugggagagaucuuuaaggcucagaggcguuugggcuccgcccuggcgaccgccgaacuagagcaggcauucacagcuauagccuuucggcagcucccuauccaagauucugaacgacuggucggucuuugucaguucgagccaaaagaaaagagagcugccagguuugcacccucguucgagcgcuuucggcuguugcagagacucaccaaccugagggugguaacuguugagggggaacgcccuuuaacagccgacgagauugcugcggcagccgcugaucugggacgaaccgccaaacucucagugaaggaaguccggaagcguaucggccuugcagccgaccacagauucgcugccuucaaagcagaugaggaagacagggauauuaucgcgcgcacgggcgaggcucugcacgggacuuaucgguugagaaaggcccuaggagagggucugugggcagaaaugcucccaggccagcuggacgccauagcucaugcccuuagcuuuuucgagacccaagaugugauucugaaagaauuggacaagcucgaccugccggcaggggugagggaugcuaucgccacaggauuagacgcgggcgccuuugcucgauucaaagguacugggcacauuagugcacgcgccgcucgggcccugcuaccccaucucgaggcaggccugagauacgaucaggcgugcaccaaggccggauaugaccacgcugccuccaggugggcaaaacgugaacaggucgcugauaaggccgcauuuaaucgccuuguuacagacaugggcgccgagaucgcuaacccuaucgcgcggaagucuuugaccgaggcccugaaacaacucugggcaaugagaaauaggugggggcugccagaugcuauucacauagaacuugcccgagacgugggaaacagccuggagaagcggcgcgaaaucgagagagccauugagaaaaauacggcugcaagggaacgggagcgaggugaagccagagauuugcucggcaucgacgauguauccggggacacucuguuacgcuacaggcuguggaaggagcaggcgggacguugucccuauacagaugcuccuauaccacccggcgccauuaucgcaaccgacaacucauuccagguggaccauauccuaccguggagucgguuuggugaugacagcuucgccaauaaaguccucugcgcuacugcagccaaccagagaaagaaggggcaaacaccuugugaauggauuaccgcggcucagggcgaggagggaugggccacguuuguggcaaggaucgaaggcaaugccgcuuuccgcgggcccaaaaagcgaaacuacguucugaaaaaugccaaggaggcagaagagagauuucgggcuaggaaccuuaacgauacccgcuaugccgcgcguuugcuggccgaagcagugaaacucuucuacccagagggagagagacaggacaaggguggcguccggaggguguuuacacgcccugggggacugacugcugccuuacgacacgcuuggggcguagaagcacugaagaaaagagaugguaagcggguugacgaugccaggcaucacgcccuugacgcuuugguggucgcggcaauuggggagggcgaagugcagcgccucaccagaucuuaccaagagugggaacagcagggacuggccaggccccuacggcgugucgauccacccuggggcgacuuccauuccuuccgccgagaggugaaagaugcuuaugacgggauauuuguugccagaccugagaggcggcgcgcaagaggagaaggccacgccgcuacaaucaggcaagugcgggagcgagauggugcggccguagucuucgaaagaaaggcaauugcugaccugucagagaaacgccucgccgacaucaaggauccagagaggaaucaggcaaucguggaagccauucggcaguggauaguugacgggcguccggcugauagacugcccaggagcccugccggagacgagauccgcaaggugcggcuucgaacuaaaggcaagccagcgguccaggugagagguggcgcagccgaucgcggggaaauuguaaggguggacguuuuuaccaaacccaacaagaaaggaaagaaugaguucuacuuggucccuaucuauccacaccaggugaugaacaaagcugaauggcccacaccgccuaugcgggccguggucgcuuacaaggaugagagugaguggacccuguuagacgaaaauuuuggcuuccucuuuucucuguucccaagauccuauguugaggugacuaagcccgggggagaagugcuuagcggcuacuuucaagguauggaucguucgacgggggcaauuucucuguucaaccauagggacucccggucauugacagaugacaguggaaauagcacccgcggcaucggugccaaaacucuccugaccaugaagaaauauuccguagaccgauuuggcaagagagcugaggucaaaucugaagugaggacauggcacgggguugccugcaccuacccuacucccccaggauga

SEQ ID NO: 2642 - RNA, 3165 nt, Artificial Sequence
  Cas9 variant
augaagcugacaccccucaacuacauccuuggccuggacuuggggauugccagcgugggaugggcugucguugagauagaugaacaggagaauccuuuaggucugaucgacgugggcguaagaaccuucgauagggcagaaguggccaaaacuggggagucccuagcgcucgcucggcgccuggcccgaucuucacguagacuugucaagaggcgggcagaccgcauuaaaaaggugaaaagacuguugaagagugaaaacauccuccugagcgccgaugagcaacugccaaaugacguuuggcagcucagggugaagggauuagaucagaaacuggagcggcaggaaugggcugcaguccuuuugcaucugcuaaagcaccgcggcuaucucucccaacgaaagaacgagucuaaaucggaaaauaaagagcugggugcccuuagaucagggguggcugccaaccaccagauucugcagagcgcggaguacaggacgccggcagaaaucgccguaaagaaguuucauguugaggaaggacacauacggaaucagcguggcgcuuauacccauacauucagucgcuuggaccuccuggccgagaucgaauuacuguuuacuagacaaaccgagcucggcaacccccacacauccgcaaaacuucuggagaauuugaccgcucuacugauguggcagaagccugcccucgcgggggaagccauucugaaaaugcuuggaaagugcacuuucgagccaacagaauacaaagcagcuaagaacucuuauagcgccgagagguuuguguggcugaccaaauugaauaaccuccggauccuggaacagggugcugagcgagccuuaacggauaaugagcgcuucgcacugcuagaccagcccuacgaaaaggccaaguuuacuuaugcucaagcgagaaccaugcucgcacugccugaugaggccauuuucaaaggcgucagguaccagggggaagacaagaaagcuguggagacaaagacuauccuuauggaaaugaaagccuaccaccagauacggaaggcauuggagaacgccgaucugaaggcugaguggaaugaacucaaaaacaacuccgagcugcuugacgacauuggaaccgccuuuucacugcauaagacagaugaagacaucugucgcuauuuggauggcaaacucagugagagcauucugaaugcauuacuggagaaccuaaauuucgacaaguuuauccaacucucucugaaagcgcuucagcagaucuugccacugaugcuccagggucaaagauacgaugaagcuguguccgccauuuauggggaccacuacggaaagaagucagcagagauaaacaggcuguuacccaccaucccugccgaugaaauucguaauccagucguucugcggacgcuuacucaggcucgaaaagugaucaacgccguagugagauuguauggcagcccggcaaggauacauauugagacaggccgcgaagucgggaagaguuaccaggaccggaaaaagcucgagaaacagcaagaggauaauagaaagcacagggaaucugcugugcagaaguucaaagaguauuuucccaacuucguuggagaaccuaaggguaaagacauccugaagaugcgccuauacgagcugcagcaggccaaaugccucuacuccggcaagagccuggaacuucaccgauugcuggagaaaggguauguggaggucgaucaugcguuaccauucucgcggaccugggacgacucuuuuaauaacaaggugcucguacuggccaaugaaaaccaaaauaagggaaaccuuacucccuacgaguggcuggauggcaaaaauaacuccgaaccuuggcagaacuucguugcucgugugcagacaucagguuuuagucacaccaagaaacagagaaucuugagccauaagcucgacgagaaaggguucauugaaaggaaucugaacgauacgcgcuaugucgugcgguuucuauguaauuucaucgcagacaacaugcugcucaccggcaagggaaagagaaaagucuuugccuccaauggccaaauuacagcucugcuuagggggcgauggggauugcagaaggugcgcgaugacaacgaucggcaccaugcccuggacgcaguugugguagcgugcucuacugucgccaugcagcagaaaauaaccagauucgugagguacgaggaggguaauguuuuuagcggcgaacguaucgaucgcgagacaggggaaauuaucccauuacacuuccccucaccgugggccuuuuuccgggagaacguggagaucagaauuuuuagugaaaauccuaagcucgagcuggaaaacaggcuucccgacuauccacaauacaaucacgaguucguccagccucuguucgugucccgaaugcccacucggaaaaugaccggacagggccauauggaaacaguaaagagcgcuaagcgccuagaugagggucucucugugcugaaaguuccauugacccaacugaaguuaaacgaccucgagagaauggucaauagggaacgggagauggcacuguaugaaucacuuaaagugcgacuggagcaguuugauaacgaccccgcuaaggccuucgcagaaccuuuuuacaaaaagggcggggccuuggugaaggcugucagaguugagcagacucagaaaaguggagugcucgugcgcgacggcaaugggguagcggauaacgccagcauggucaggguggacguuuucacgaaggcaggaaaauacuuucuggugccaauauauacauggcaagucgcuaaggguauccuaccgaacaaagccgugaccgccaauguugaugagauugacuggcuggaaauggaugaguccuaccaguucaucuuuacuauguaucccaacgaccuugugaagguaaaacucaagaaggaagaguucuuuggcuacuaugggggacuggaucgugcuaccggcgcaauugucaucaaagaacacgacuuggagaagucuaaaggucggcaggggauauacagaaucggcgugaagcuggccuuaucguucgagaaauaucagguggaugaacucggaaagaauauuaggccuugucgcccaacaaagcgacaacaugucagauga

SEQ ID NO: 2643 - RNA, 3165 nt, Artificial Sequence
  Cas9 variant
augagaauccugggcguggaccucggggucgccagcguuggaugggcucuugugaacgauaagaauaacaaaauuauagacuccgguguaaggaucuucacccagucuacaaaucgggagggcaagacucuggcagccgugcgccgaucauuucgugggggaagaagggucuugagucggcgcaaacaaagauuaaaccagcugaagaaacuauucauugcgcacaagcuccugagcaaguccgaauuuaaacaucuuuucaauucuaagaacaggcuggauaucuggcaguugcgggcuaaaggccucgagcagcaacugaauaacaaggaaugggcccgcgugcuguaccacauugcaaaaagacgagccuaucagucgaauaggaagucagaggaaagcgguaacacggacaagaaaaagguucucagugggaucuccaaaaaugagaagaaaaugaacgaguuaggauacaagaccauaggcgaaaugcuguauacagagaaucgguaccccgauaaccguauccgcagaaauaaaaaggaccaguauaagcauucuauuagcagggaucuuuugcggaaagaaaucgacgugcuguuugagucccagcgagauuucggcaaccaauuugcuacugacgggcuaaaggagcacuacaaagauauugcauucacccagcgcccuaucaaguuuaaagccgaccucgucggaaagugcacauucgaaacccaggaguauagaggugcuaagaacuguuuuucaguggaaaagaguacucugcuuagcaagauaaauaacacagaucugauugacaaaucuaccggcgagaucaagagguuguucgaaauuuccgaguuugacaaacuccuggauaucuucuacucaaucaaggagguaaaguacacgacuuuacggaaacagcugaagauuaccgacgccuucaaauuuaagcaacucgauuaucaucagaauuucgaauacaaaacaaacauaaaggcgaagaucgaggacuuuuauaaacuugaagauuggcugacuccagagcagaagguuuugcuagaaaaacaagugcuggacgauaagaaagagaaguucaaaugcuacaaguauagcaguauucgcucuauccucucccugagcgagucgcagaaguuuaauggggucaaauacgacaccaagguggaaaacacaguguucggaaaacuuaauggcuaucacucuauaaagaaagagcugaacaaggaagucuuugauuugcuguucauugacaaggauaaauuuaauaagaucgcagagauccuguccuaccagaaagacgacaagucagccacccaggauuuaaagaagcaaguuuucaacgacuuuaauauggauaagacgauugugaacgaagcuaucaauagucugcuaaacauuagcuucuccgguuuuaauucucucagccugaaagccauaaacaaacuuuugccguaccugugucaggggcucaaauaucacgacgcaguagcucauucagaguacaagcaccauagucaguucaaagccgcgaacccccagcaauaucugagaccucuuaauaaggaggaaaacuaccagaucacuuccccaacagugaagagggucuucagccaguuucguaaagugcugaaugccguuauucggaagcacggaucuuucgaugcaaugcacaucgagauggcucgagaauugaaaaacucaaagaaaaucaaguuugagauucagaccggccaaaaagaguaugcccaggaaaaggaggcuauaagagugaaguuccucgaaaucuuuaaauacgagggcagugggagggaccuguuaaagcugcgccuauaugaacagcagcauggaaaaugcauuuacagcaagaaagagaucgagauuaauaagcuccuggaagaugguuacgucgagaucgaccacauacuucccuggucccggacuuucgauaacucuuugaauaacaaggcccugugucucucggcagaaaaucaaaacaaagccaaucagacaccuuuugaguaucugaccaacagcgacaaaaauuccaaagauucaaaggaauggcaggaguacaaaaacuaugugaguucuuucgcuggcaucaagcaagcgaagaaacauaaguuacugaauacgacccuuccacccagaagggggaacgacuuuagcgaugacauuaaaaacccugaguccggauucuuggcacgcaaucucaacgacacagccuacgcuucacgauuuaucaagaauuucguacagaaccaccuccaguuuagccagaaugauacuauuaaacaaaagguuaaggugcggucuggcgcccuaaccaaccagcugcguuauaauugggguaucgaagagaaaaacagagacaauaaccuccaucacgcagaagaugccauaauucuggcuuucgccacacagggggagguccagaggauguccacuaucagugcaaagcgcgaagacuucaaauaccaaaccgcgaaggagcggaaaauuaaguuuacaccaccguucagcgauuuuaagucugugcuugacgaguccgucggcgauaucuucgugucauuugcucccagaaggaaaauaaguggagccgcacacaaggccaccaucaaaccuaaggacacuggcgggaaauauaaguucccaguuaauaacggaauggcugaaaauggugugauucagcgaguagaugucuuuaaaaacgccaagaauaaguaccaguucaucguguuuuaccccgcagacuucuauaaagaugacuuuccugaguuggaucugaagggcaacgaaauugacaaaaacguucaguucuuauucagccucuuuaaggacgaucugaucgaguucaaaacgaagaagacaaaaaccaaggacucgaaacaucuucuggcuuacuuuaaguauauacgcuccgaugggaaaauugccuuccaacagaauuacaaggcggagaucgaacggaaggagucugacaacaaaaagggauauaaagauaucuugcucgccacuggcagcggucuggcuucacuaaagaaauaccaggugaguguccugggggacauugcagaagugaagaaugagaagagacucccacugaucaaacaaauguauaaguccaaacccaagaaaaaguga

SEQ ID NO: 2644 - RNA, 3165 nt, Artificial Sequence
  Cas9 variant
augaaccagaaguucauccugggccucgacauugggauaaccagcgugggauacggucuuaucgauuaugagacaaagaauauuaucgacgcaggcgucagacuguuucccgaagcuaacguugagaauaacgaagggaggcgguccaagcgcggaucucgacguuugaaaagaaggcggauucaccgcuuagagagagugaagaaacugcuagaagauuacaaucuccuggaccaaucacagaucccucagaguacuaacccauaugcaauaaggguaaagggccuuagcgaggcccuguccaaggaugaguuggugaucgcgcuccugcauauugcuaaacggcgcgguauccacaagauugacgucaucgauucuaaugacgauguggggaacgaacugucgacgaaagagcagcucaauaagaacucaaaauuacugaaggacaaguucguuugccaaauacagcuugaacgaaugaaugagggacaggugagaggcgagaaaaacagguuuaagaccgccgauauuaucaaagaaauuauccaguugcugaauguccaaaagaacuuccaucagcuagacgagaauuuuaucaacaaauacauugaacucguggagaugcggcgugaauauuucgagggcccggggaagggaagccccuacgguugggagggcgauccuaaagcaugguaugaaacacugauggggcacuguacuuacuuuccagacgagcuucgcaguguaaaguacgccuauuccgcugaccuguucaacgcauugaaugaucucaacaaucugguuauacagagagacggauuaucuaagcuggaauaccaugagaaauaucacaucauugaaaacguguuuaagcagaaaaagaaacccacccucaagcaaaucgccaaugagauaaacgucaauccugaggauauuaagggcuacaggaucacaaaaagcgguaagccacaguucaccgaauuuaaacuuuaucacgaccugaaguccguguuguucgaucagucaauccuagagaacgaagacgugcuggaucaaauugcugagauccucacuauuuaccaggacaaagauaguauaaagagcaagcugacagaacuugacauccuguugaaugaggaggauaaagaaaacauugcccagcucaccggguauacgggaacucaucggcugucuuuaaagugcauccgacugguccuagaggaacagugguacuccucacgcaaucaaauggagaucuuuacccaccucaacauuaaacccaagaaaauaaaucugacagcggcaaacaagaucccuaaggccaugauugacgaguucauccuuagcccaguugugaaaagaacuuucggccaggcuauuaauuugaucaacaagauaaucgaaaaauacggcguaccggaggacauuaucauugaacuggccagggagaacaauaguaaggauaaacagaaguuuaucaacgaaaugcagaaaaagaaugagaacacccggaagcgcauaaaugagauuaucgggaaauauggaaaccaaaaugcaaagagacucguggaaaagauuaggcugcaugacgagcaggaagguaagugucuuuacucucuggaguccauccccuuggaagaucuccugaacaauccuaaccacuaugaggucgaccacauaaucccacguagcgugucguucgauaauucuuaccauaacaaaguuuuagugaagcaguccgaaaauucaaagaaaaguaaccugacacccuaucaguacuuuaauagcggcaaguccaaacuaucuuauaaccaauucaagcagcacauucucaaccugagcaaaucacaggaccggaucaguaagaagaaaaaggaauaccuuuuggaggaacgagauauuaauaaauuugagguccagaaggaguucaucaacagaaaucugguggacaccagguacgcuacgcgcgagcucacuaacuaucugaaagccuacuuuuccgcgaauaacaugaauguaaagguuaagacaauaaacgggagcuucaccgauuauuuacggaaaguguggaaguuuaaaaaggagagaaaucauggauacaaacaccaugccgaagacgcacugauuaucgcuaacgccgauuuccuuuuuaaggagaauaaaaaguugaaggcugucaacucugugcucgaaaaaccugagaucgagucaaagcaacuggacauucaggucgauagugaagacaauuauagcgagauguucaucauuccaaaacaggugcaagacauaaaggauuuuaggaacuucaaauacucccaccgcguugacaagaagcccaaucgacagcuaaucaacgauacucuguauucuacacggaaaaaggacaacucgaccuacauugugcagacgaucaaagauauuuacgccaaggacaauaccacacucaaaaagcaguucgauaagagcccggaaaaauuucugauguaucaacacgacccucguacuuucgagaaacuugaaguaaucaugaaacaguacgcaaacgagaagaaucccuuggccaaauaucaugaggaaaccggcgaguaccugacaaaguauuccaagaaaaacaaugguccaauagucaagucauuaaaauacaucgggaacaagcucggcagucaccuggaugugacucaucaguuuaaaucuagcaccaagaaacuuguuaaacuguccauuaagccuuauagauucgacguguacuugacagauaaaggauacaaguuuaucaccauuucauaucucgacguccugaaaaaggauaauuacuauuacauccccgaacagaaauaugacaagcuaaagcugggcaaagcuauagacaagaacgcgaaauucauugccagcuuuuacaagaaugaucucaucaaacuggacggggagaucuauaagauuauaggagugaacucugauacuaggaauaugaucgaacuugacuugccagauauucgcuacaaggaguacugcgagcugaacaauaucaaaggugaaccccggauuaagaaaacgaucggcaagaaaguaaacuccauagagaaguuaacaaccgacgugcucgggaauguuuucacuaacacccaauauacaaagccucagcugcuuuuuaaaagaggaaauuga

SEQ ID NO: 2645 - RNA, 3165 nt, Artificial Sequence
  Cas9 variant
augaagcugacaccccucaacuacauccuuggccuggacuuggggauugccagcgugggaugggcugucguugagauagaugaacaggagaauccuuuaggucugaucgacgugggcguaagaaccuucgauagggcagaagugccaaaaacuggggagucccuagcccucgcgcggcgccuggcucgaucugcccguagacuugucaagaggcgggcagaccgcauuaaaaaggccaaaagacuguugaaggcugaaaacauccuccugucagcagaugagcaccucccgaaugacguguggcaacugaggguuaagggauuagaucagaaacuggagcggcaggaaugggccgcugugcuuuugcaucugcuaaagcaccgcggcuaucucagucagcgaaagaacgagagcaaauccgaaaauaaagagcugggugcccuucugucuggggucgagacgaaccaucaaauuuugcagucggcggaauacagaacccccgcagagaucgccgugaagaaguuucacguagaagacggacauauaaggaaucagcggggcgcuuauacacacacuuucucacgucucgaucuguuagccgagauggaacugcucuuucagcgccaaaccgaccuuggcaacccucacacaagcgcaaaacuguuggagaaucuaaccgcucugcucauguggcagaagccagcccuggcgggggaggccauccuuaaaaugcugggaaagugcacuuucgaacccacagaguacaaagcagcuaagaacaguuauuccgccgaaagauuuguuugguugaccaaacucaauaaccugaggauuuuagagcagggugcugaacgggcccugacggauaaugagcgauucgcacuacucgaccagccuuacgagaaggccaaguuuacuuaugcucaagcgcgcaccaugcuggcacuuccagaugaagccaucuucaaaggcgugagauaccagggggaggacaagaaagcugucgaaacaaagacuauuuugauggagaugaaagccuaccaucagaucaggaaggcacuggaaaacgccgaccucaaggcugaguggaaugagcugaaaaacaacucugaacuucuggaugacauaggaaccgccuuuagcuugcacaagacagaugaggacauuugucgguaucucgauggcaaacuguccgaaucaaucuuaaaugcacugcuagagaaccucaauuucgacaaguuuauucaacugagucuuaaagcguugcagcagauccugccccucaugcugcagggucaacgcuacgaugaggcugugagcgccaucuauggggaccauuacggaaagaagucugcagaaauuaacagauuacugccuaccauaccagccgaugagaucaggaauccggugguccuucguacguugacucaggcucggaaaguuauuaacgccgugguacgacucuauggcucccccgcaagaauccacauagaaacaggcagggagguggggaagucauaccaggaccgcaaaaagcuggaaaaacagcaagaggauaaucggaagcagagagagagcgcugucaagaaauucaaggaauauuuuccuaacuucgugggagagccaaaagguaaggacauucuaaaaaugaggcuguacgaacuccagcaggccaagugccuguacaguggcaaaucucuugaguugcaccgccuguuagaaaagggguauguugagguggaccaugcgcuccccuucucccgaaccugggaugacagcuuuaauaacaagguccuggugcuugccaaugagaaccaaaauaaaggaaaccugacuccuuacgaaugguuggauggcaagaauaacucggagcacuggcagaacuucguagcucggguucagacaucugguuuuucccauaccaaaaagcagcguauccucucacacaaacuggacgaaaagggguucaucgagagaaaucuaaacgauacgagguauguggcacgcuuucuguguaauuucauugccgacaacaugcuccugaccggcaagggaaaacggaaggucuuugcuaguaauggccaaaucacagcccuuuugagagggagguggggacugcagaaagugcgagaugacaacgaucgccaucacgcauuagacgcggucgugguugccugcagcacugugguaaugcagcaaaagauuacccgguucgucagauacgaagaggguaauguguuuuccggcgagaggauagaucgugaaacaggggagaucauuccacuccacuuccccucuccgugggcuuucuuccgcgaaaacguugagauccggaucuuuagcgagaauccuaaacuggaacuugagaacagacugcccgacuauccacaguacaaucaugaauuugugcagccucuauucgucucaaggaugcccacucgaaagaugaccggacagggccacauggagacagugaagagugccaaacggcucgaugaaggucuguccguauugaaggugccacugacccaauuaaaacucagcgaccuggagcgcaugguuaacagagagagggaagucacucuuuaugagucucugaaggcacgguuggaacaguuugggaaugaccccgcuaaagccuucgcagagccuuuucauaagaagggcggagccguggugaaagcuguccgaguugaacagacgcagaagucaggcgugcucgugagagaugggaacggaguagcggacaaugccaguaugguccgcguggauguuuucacaaaagguggcaaguacuuucuggugccaauuuacaccuggcaagucgcaaaagggauacuaccgaacaaggcugugacugccaacguugacgagaucgauuggcuggagauggacgaaagcuaucaguucauuuuuaccauguaccccaaugaucuugugaaaguaaagcucaagaaagaggaguucuuuggauauuacggcggucuggacagggccacaggggcuaucgucauuaaggaacacgauuuggaaaaauccaagggcaaacagggaaucuaucguauaggcgugaagcuggcauuaucuuucgagaaguaccagguggacgagcucgggaaaaacauccggccuuguagaccaaccaagaggcaacacguccgcuga

SEQ ID NO: 2646 - RNA, 3165 nt, Artificial Sequence
  Cas9 variant
augaaggagaaauacauccugggccucgaccuugggauuaccagcgugggauaugguauaaucaacuucgaaacaaagaaaauuaucgaugccggcgucagacuguuucccgaggccaauguugacaacaaugaagggaggcgguccaagcgcggaucucgacguuugaaaagaaggcggauucaccgcuuagagagagugaagcugcuacucacugaauacgaucugaucaacaaggagcagauaccuacgucaaauaacccauaucaaaucaggguaaaaggccuuagugagauucugagcaaggacgaauuggcaaucgcccuccugcaucuggcgaaacggcgcgguauucacaauaucaacguguccucugaggaugaagacgcuucgaaugagcucucaaccaaggagcagauaaaccgaaauaacaaauuacugaaggauaaguacgucugcgaagugcagcuucagagauugaaagaggggcaaauuaggggagaaaagaaucgguucaaaacaacugacauccugaaggagauugaucagcuacucaaaguucagaaggacuaucauaaccuggauaucgacuuuaucaaucaguacaaagaaauuguggagacccgucgcgaguauuucgaaggcccgggccaagggagccccuuuggauggaacggugaucuuaagaagugguacgagaugcugaugggccacuguacauacuucccucaggaauugagaagugucaaauaugccuacuccgcagaccucuuuaacgcccugaaugacuuaaacaaucugauaauccagagggauaacucugagaagcucgaauaucaugagaaauaccacauuaucgagaauguguucaagcagaaaaagaagccaacccuuaaacaaauagcuaaggaaauugggguaaaccccgaggacaucaaaggauaucggaucacuaagagcggcacaccucaguuuaccgaguucaaacuguaccacgauuugaaguccauuguuuuugacaagucaauccuagagaaugaagcaauucuggaucagauagccgagauccucacgauuuaucaagacgagcagaguaucaaagaagaacugaacaaacuuccagaaauccugaaugagcaggauaaggcugagauugccaaguugauagguuacaacgggacucaucgacucagccugaaaugcauccacuuaauuaaugaagaacuguggcagaccucucgcaaccaaauggaaaucuucaauuaccuaaacauuaagcccaauaagguggaccucuccgagcagaacaaaaucccuaaggauauggucaacgacuuuauacugucaccaguggugaaaagaacauucauccagagcauuaaugucaucaacaagguuauugaaaaauauggaaucccggaggauauaauuaucgagcuugcgagggaaaauaacagugacgaccggaagaaauucauuaauaacuugcagaagaagaaugaggcaacucgcaaaagaaucaacgaaauaaucggccaaaccggcaaucagaacgccaagaggauuguggagaaaauccgucugcaugaucagcaggaagggaagugucucuacucucuggaguccauugcucuuauggaccuguugaauaacccccaaaauuaugagguagaucacaucauaccucggagcguggccuuugacaacucgauucacaauaaaguccucgugaagcagaucgaaaacucuaagaaaggaaaccgaacaccauaccaguaucuaaauuccucagaugcaaaguuaaguuacaaccaguucaaacaacauauccugaaucuaagcaaguccaaagacagaauuucuaagaagaaaaaggauuaucuccuggaggaaagggacaucaacaaauuugagguucagaaggaguucauuaaucgcaaccuuguggauacccgguacgcuacgagagaguugacuagcuaccugaaagccuauuuuucagcgaauaacauggacgucaaggugaagacaauaaaugguaguuucaccaaccaccucaggaaaguauggcgcuuugauaaguaccgaaaucauggcuauaaacaccaugccgaggacgcacugaucauugcuaacgccgauuucuuauuuaaggaaaauaaaaagcugcagaacacuaauaaaauccuugagaagcccacaauugaaaacaacaccaagaaaguuacgguggagaaggaggaagacuacaauaacgucuucgagaccccuaaauugguggaagacaucaagcaauaucgggauuacaaauuuucccaccgugucgacaagaagccaaauagacagcucauaaacgauacacuguauagcacuaggaugaaagacgagcacgauuacaucgugcagaccauuacagacaucuacgggaaggauaauacuaaccugaaaaagcaguucaauaaaaaccccgaaaaguuucugauguaucaaaaugacccgaagaccuucgagaaacucucuauuaucaugaagcaguacucagaugagaaaaacccucuggcuaaguauuacgaagagacaggagaauaucuuaccaaauacaguaagaagaauaacggccccauaguuaaaaagauuaaauugcuggguaauaagguggggaaccauuuagacguaacuaauaaauaugagaacagcacgaagaagcucgucaaacuguccaucaagaauuaccgcuucgauguguaccuuacagaaaaaggcuauaaguuuguuaccaucgccuaccugaacguguucaaaaaggacaacuauuacuauauuccaaaagauaaguaccaggaguugaaggagaaaaagaaaauaaaggacacugaccaguuuaucgcaucuuucuauaaaaaugaucucauuaagcugaacggagaccuauacaagaucauuggcgucaauucggaugaccggaacaucauagaacuggauuacuaugacaucaaauacaaggauuauugcgagauuaauaacaucaaaggggaaccuagaauuaagaaaaccaucggaaagaagacagagagcauagaaaaauuuaccacugacgugcucgguaaucuguaccuucacuccacagagaaggcuccccaauugauuuucaaaaggggccuguga

SEQ ID NO: 2647 - RNA, 3165 nt, Artificial Sequence
  Cas9 variant
auggagaacaagaaucugaacuacauccucggccuugaccuggggauugccagcgugggaugggcugucguugaaauagaugagaaagaaaaucccuugagauuaaucgacguggguguaaggaccuucgagcgggcagaagugccuaagacaggcgagucccuggcccuaucucgccgacucgcgcguucagcuagaaggcugacucagcggcgcgucgccagacuuaaaaaggcaaaaaggcuguugaagagugagaacauucuccugagcacggaugaacggcugccacaccaaguguggcagcuccgcguugagggguuagaccauaagcuggaacgacaggagugggccgcugugcuuuugcaccugaucaaacauagaggauaucuaucccagaggaagaaugagucuaaaucggaaaacaaggagcucggcgcacugcuuucaggugucgauaauaaccacaaacuguugcaacaggccaccuaccggagcccggcugaacucgccgugaagaaguuugagguagaagaggggcauauucguaaucagcagggagcguauacacacacuuucagucgccuggacuuacuggcagagauggaacuccuuuucuccagacaacagcacuucggcaaccccuuugccucugagaaacuguuggaaaaucuaaccgcucugcucauguggcagaagccugcccugagcggcgaggcaauccuuaaaaugcuggggaagugcacauucgaagaugaguacaaagcugccaagaacaccuauuccgcggagagguuuguuuggauaacuaaauugaauaaccuccggauccaggaaaauggacuggagcgagccuuaaacgacaacgaacgccuggcacuaauggagcaaccauacgauaagaauagacucuucuauucacaggugaggaguauucugaaguugagcgacgaagcuaucuuuaaagguuugcgguacucuggcgaggauaagaaagccauugagacaaaggcuguccugauggaaaugaaagccuaccaucagauccgcaaggugcucgaggggaacaaucugaaggcagaaugggccgagcuuaaagcuaaccccacccuguuggacgagauaggaacggcguucucccucuauaagacugaugaagacauuucagcauaccuggccggcaaauuaagccaaccugugcugaaugcucuacucgagaaccugaguuuugacaaguucauccagcuuucuuugaaagcccuguauaagcuccugccauuaaugcagcagggucugagauacgaugaagcauguagggagauuuauggggaccacuacggaaagaaaaccgaagagaaucaucacuuucuuccccaaaucccugccgaugagauccguaacccagucguuuugcggacacucacucaggcucgaaaggugauuaauggcguagugagacuguauggcuccccggccaggauacacaucgaaaccgggcgcgaggucggaaaaagcuacaaggaccggagagaacuagagaaaaggcaggaagagaaccgcaagcagcgagagaaugcaauuaaggaauuuaaagaguacuucccccauuuugcgggugaaccuaaggcuaaagauauccugaagaugcggcucuauaaacaacagaacgccaagugccuguacucgggcaaaccaauagagcuucaccguuugcuggaaaagggguauguggagguugaccaugcauuacccuucucuagaacaugggaugacuccuuuaauaacaaggugcucguccuggccaaugagaaccagaacaaaggaaaucuuaccccuuucgaauggcuggauggcaagcacaacucagagagguggcgcgcuuuuaaagccuugguggaaacgagugcauucccauacgcuaagaaacagcggauucucagccaaaagcuggacgagaaggguuuuaucgagagaaaucuaaacgauacuagguauguagcccgauuccuguguaauuuuaucgcggacaacaugcaucucacaggggaaggcaaacgcaagguuuucgccuccaauggacagauuaccgcucugcuucggucuagauggggcuuggcaaaaagcagggaggacaacgaucgucaccacgcccuggacgcuguggucguggccugcucaacugucgcaaugcagcagaagaucacacgcuuugugcgguucgaagcgggggauguuuuuaccggagagagaauugacagggaaacgggugagauaauccccuuacauuucccgaccccuuggcaauucuuuaaacaggagguggaaauucgaaucuucagugauaaucccaagcucgagcuggaaaaccggcuuccagaccgcccucaggccaaucacgaguuuguacaaccccuguucgucuccagaaugccaacaaggaagaugacuggccaggggcauauggaaaccgugaaaagcgcuaagcggcuaaacgagggaaucucuguuauuaaaaugccccucacaaagcugaaauugaaggaucuggaguuaauggugaaucgagaaagagagaaggaccucuacgauacucugaaagcccgccuugaagcauuuaacgacgauccugcuaaggccuucgcagagccauuuauuaaaaagggcggugccaucgucaaaucagugaggguagaacagauucagaagaguggggugcugguucgugagggcaauggagucgcugacaacgcgagcauggugcggguggaugucuucaccaaaggcgggaaguauuuucuuguuccgaucuacacauggcaaguggccaagggaauacuccccaacaaagcagcuacccaguacaaggacgaggaagacugggaggugauggauaauuccgccacuuucaaauuuucucugcacccuaacgaccuaguaaagcuggucacgaaaaagaagacaauccuugguuauuucaauggccucaacagagccaccgggaauauagauaucaaagaacacgaccuggauaagucgaaaggaaagcagggcauuuuugaggguguggggaucaaauuggcucugagcuucgagaaguaccagguugacgaauuaggcaagaacauuaggcucuguaaaccauccaagcgccaacccgugcgauga

SEQ ID NO: 2648 - RNA, 3168 nt, Artificial Sequence
  Cas9 variant
augaacaauuacauccugggccucgacauugggauaaccagcgugggauaugguaucgucgauuccgacacaagagagauuaaggaugccggcguuaggcuuuuccccgaagcuaacguggacaauaacgaggggcggcgcucuaaacgaggagcacguagacugaagaggcggcgcauccacagauuggauaggguaaaacauuuacuggccgaauacaaucuacucgaccugacuaacauuccuaagucaacgaauccauaucagauccgggugaaaggccuuaacgagaagcugaguaaggaugaauuggucauagcgcuccugcacaucgcuaaacgccgagguauucauaaugugaacguuaugauggacgauaaugacagcgggaacgagcuguccaccaaggaucaacucaaaaagaaugccaaagcauuaucugacaaguacgugugcgagcugcagcuugaaagauuugagcaggauuauaaggucaggggagagaaaaaccgguucaagacagaggacuuugugcgugaggcccgcaaauugcuggaaacucagucgaaguucuuugagaucgaccaaaccuucauuaugagauacaucgaucuaguagaaacaaggcgggaguauuuugaaggcccgggcaaagggucacccuucggaugggaggguaauauaaagaaaugguuugagcagaugaugggccacuguaccuacuucccugaagaacuccgaagcguuaaguacgcuuauagugcagaacuguuuaacgcccuuaacgaccugaauaacuuggugauuacucgcgaugaggaagcuaagcucaauuacggggagaaauuccagaucauugagaacgucuuuaagcagaaaaagacaccaaaucugaaacaaaucgccaaggaaaucggaguguccgagaccgacauuaagggcuauagagugaacaaaucugguaagcccgaguucacgcaguucaaauuauaccaugaucugaagaauauauuugaagacagcaaauaucucaacgauguccagcuuauggacaauaucgcggaaauuaucacuauauaccaggauccugaguccauuaucaaggagcugaacuugcuaccagaacugcucucagagaaggaaaaagagaagaucagugcacugagcggguaugccggaacccacaggcuuucucugaaaugcauuaauuugcuccuggacgauuuaugggaguccucacugaaccaaauggaacuauucacaaagcucaaucugaaacccaagaagaucgaccuuagccagcagcacaaaauuccuauaaaguugguugacgauuuuauccugaguccagugguaaaacgggcuuucauucaaucuauccagguggucaacgccaucauugacaaguacggccucccggaggauauaaucauugaacuggcacgcgagaauaacuccgacgauagaaggaaauuucuuaaccagcugcagaagcaaaaugcugaaacucguaaacagguggagaagguuuugcgggaguacggcaacgacaaugccaagcgaaucgugcagaaaauuaagcuccauaacaugcaggaagggaaaugucuguauagcuuaaaggauaucccccuggaggaccuacucaaaaauccuaaccacuacgaagucgaucauauaaucccaagaucgguggcguucgacaauucuaugcacaacaagguacugguuagggccgaggaaaauuccaagaaaggaaaccgcacccccuaucaauaccuuaauucaagugagagcuccuugucuuauaacgaguuuaagcagcacauucugaaucucagcaaaacaaaggaucggaucaccaaaaagaagagagaauaccuguuagaggaaagggacauuaacaaauaugaugugcagaaggaguucaucaaucgcaaccuggucgacacgcgauacgcaacucgggaacuuacaucauugcucaaggcuuacuuuagugccaacaaucuggacgugaaagucaaaaccauaaacgguuccuucacuaauuaucuacguaagguguggaaguuugauaaagacagaaacaagggcuacaaacaucacgcugaggaugcccugauuaucgcaaaugccgacuuccucuuuaagcauaacaaaaagcugaggaauauuaacaaaguucuugaugcuccuagcaaggagaucgacaagaaacgcgugacaguacagucugaagaugaguauaaucaaauguucgaagacacccagaaggcgcaggcaaucaaaaaguucgagauacggaaauuuucacacagagucgauaagaagccaaacaggcaguugauuaaagacacgcuguacaguacccgaaauaucgaugggauugaguaugugguugaaagcaucaaggacauauacuccgugaacaaugauaaagucaagacaaaauucaagaaggacccccaucgcuuacucauguaucggaacgacccgcaaacuuuugagaaauucgaaaagguguuuaaacaguacgagucugaaaagaauccuuucgccaaauacuaugaggagaccggagaaaagauuagaaaguuuucgaaaacaggccagggucccuacaucaacaagaucaaauaucugagggagcgucuugggcgccacugcgauguaacuaacaaguacauuaauagccggaacaaaaucgugcaacugaagauuuauuccuacagauucgacauauaucaguacggcaauaacuacaagaugaucaccauuucauauaucgauuuggaacagaaaaguaauuacuauuacauuucuagggagaaguaugaacagaaaaagaaagacaagcaaaucgaugacagcuacaaauuuauaggauccuucuauaagaacgauaucauuaauuacaacggcgagauguaccgaguuaucggggucaaugacucagagaagaacaaaauucagcucgauaugaucgacauaagcauuaaggauuauauggaacugaauaacaucaaaaagacaggagugaucuacaaaaccauugguaagucuacuacgcacauagagaaguauacaaccgacauccuaggcaaucuguacaaagcugccccaccuaagaaaccccagcucauuuuuaagcgggggauggaauga

SEQ ID NO: 2649 - RNA, 3168 nt, Artificial Sequence
  Cas9 variant
augacccccaucagcgagucccuacucuucggccuugacguggggauuucuucaugcggaugggccguccugaagcacagugauacaacuggucauauagaggcuuugggcagcugguguuuuaacgcaccugaaacgaaaaccgaaagaacaccaacuaaucagaucaggcgguccucucgcuuacugcgacguguugugagaaggcggcgcaacagaaugaccgagauuaggcggcuauucgcccgccacgggcucaucgacaaugaucgaccggacgcgcugagacaacccgcuauugauccuugggaaaugaggggacagggccuugaccggcagcugacaccagaggaguuugccguagcauuggcccauaucgcuaagcaccgugguuucaaaucgucagcaaagcgcgugaaaagcaacgccagucccgaugacuccaagaugcucgcugcccuggaaaagaccaaagagcugucugcgcaguacagaacuauaggggaaauguuugcaagggauagcgccuauguccaacggcgacgcaauagagacggacucuucgauaggacaaucucccgggacgauuuaauugacgaggcuaagauccuguuugaccgccagagaaaacuuggcaacccuguggccucaaccgagauugaagaggcauucacgaggaucgcuuuuuggcagaauccaaugcaggauaguggcguuuugguggccagcugccccuucgaaccuaaggagaaacguucuucccgguuuucaccgagcuucgaacgauuuagacugcuauguaggcucauaaaccugcgcgucacugacgggccagaggagcggccccuuaccgaagaggaacugagauuggcguacgagcaugccggaaagacaaggaagcucacugcagcugccauucgcaaacugaucgguuuacgagaugaccaacacuucaccacaauuccuccagaacaggagaagcaggauaucaccagucggacgggcgagacuuucgcugggacagccaccuuucguucugugcugggagaaucccucuggagacagcuucugccccacccugagugguuggacaaugcagccuggaucauuagcuuccaugaacuaacugagacaauaaucaaaaagcugggcgaaauuggucucccaguagaggcuuaugagcugaucugcgaugcgcuuaaaucggacaagucucccuuugcaaaauucaagggggccuccucacugagugauaaggcuguuagggccuugauaccguaccuccaacagggacugaccuaugacaaagcaugucagaaggccggcuacgaucacgcugccagccgcuuuuccggccgggcaacgauugacaccaaagcgaaguucaacgcuuuaauggccgaagugagagacucuaucgcaaauccuaucgccaggaaagcucugagcgaggggaugaagcaacuaugggccaugcgaaaccgcuggggacuccccggugcaauuugcaucgaacuggcucgggaugucggcaauucacuugagaagagaaaagagauugaaaggaacuugaagacaacugccaaacagcgugcgcgcgagcgggaagaggccugugaacugcucaaucugaaggaggugaguuccgacauacuucugagauauagguuguggaaagagcaagggggacgaugcuguuacagcggcaagucuaucaccccagauaugcucauggcucaggacaaccggauucagaucgaucauauccugccuuggucacgcuuuggugacgauaguuacagcaacaagggguuaugccuggcaaaagaaaaucaggccaagaaaaaccagacacccuaugaguggauucacggccagggaacuaccgcucaaaaggaacagugggacaaauucguggccgaugucgaguccagaaagaauacaaagggccugaaaaagaggaacuuucuccugaaagggucuaaggaaauagaggagcgguuccgaucgagaaaucuuaacgacacccgcuacgcagcgagguugaugguugaagccgcucgucugcucuauccagccggacagcggggugagaaaggcgggacuagaaggguguuuacgcgccccggagcacugacagcugccuuacgacacgcauggggcguagaaagccugaagaaaaucgauggugagagacuucaugacaaucggcaccaugccuuggaugcugcgauuguggccgcagucuccgaagcugagauccagaagcucaccaagucauuccaagagugugaacagaaagggcugaguaggccuaugcgcgacguggccccaccgugggacggcuuucgugaucagcuaaaggagaaauacgaaacuauuuucguugccagacccgagcggcagagggcucgcggacaaggccacgaggcaaccauccgacaggugagagaagaggaaacagggccugucauauaugagcggaaggccgugucugcgcugacccucgcugaccuggccaaaaucaaggauccagacaggaacgcaggacuuauugccagcuugcgccaguggaucgaagcugguaagcccgcagauaaaccuccaagaacucccugccaucaauccgccgcgggccacgagauuaggaagguacggcuggcuacaaucauaacgccggccguuccugugcgugggggaauggcaaaacgcggcgagaugacccgagucgacauuuucaaggugaucgguaaaaaggggaagccagaaugguacaugauucccaucuauccucaccagauaaugaauagaucacaguggcccgccccaccuaacaaagcugucguggccggcaagagcgaggcagauuggcccaucaugggagcugaagcccaguuucaauucucuuuauacccaugcuccuacguuaggcucuuuaaagagggcacugugauugaaggguauuucuguggaugccaucggagucgcgcguacaucacacuggcccuuagcaccggcgcagcuccgcugcagaaggguauugggaucaaaacacaggagcacauacagaaguuuucuguaaauagauucggagaguuguccccugucaagcaagaaacuaggaccuggcauggcguggccuguacgucacccgaccagcacgauuga

SEQ ID NO: 2650 - RNA, 3171 nt, Artificial Sequence
  Cas9 variant
augaaggcccugaacuacauccucggccuugaccuggggauugcuagcgugggaugggcagucguugagauagaucagaaugaauugcccaucagauuaauugaccugggugugaggaccuucgagcgggccgaaguaccuaaaacaggcgauucccuagcgcucgcucgccgacuggcccguucuucaagaaggcuugugcggcgcagagcagucaggcuguugaaggccaaacggcuccugaagcaagaggggauccugcaggcugacgauuuucacaguagccaucucaaaccauuaccgaacaaucccugggaacugcgcgugaagggacuuaaccacuugcuggaccgaaaggagugggcagccguucuacuccaucugcuuaaacacagaggcuaucugucccagaggaagaaugagucuaaaacugauaacaaggaauugggugcucuccugaaaggggugucggagaaucggcaguuacugcaagcccaggcguucucaacgccugcagaaauugccaucaagaaguuucagcaggaggagggacauauacguaaccaacgcggcgcuuacagccacaccuucgacagaaaugaucuccuugccgaacugagguugcuauuucagaaacagcgggaguucaacaauccauauacaagucagucccuggaacaagcaaucgcugagcuccugauguggcagaagcccgcccuuucuggcgaagcgauucugaaaauguuggggaagugcacuuuugagccuagcgaguacaaagccccaaagaacuccuauucagcagaauacuucgucuggcucaccaaacugaauaacuuacgaauccuggagaauggagcugaccgcggucuaacagccgaagagagacagcuccugauuaaccaacccuuugaaaaggcuaaguucaccuaugcccaggcaaggaaacuuuuggagcugagugaucucgccaucuuuaagggcgugcgguacgggaaagacaacgcugagagcgcgacucugauggaaaugaaggcauggcacgccauacgcaaagcucuugagucuaauggacugaagacagaauggaacggcuugaagaccaaaccugagcuccuggauaagauugguacggccuucuccaucuacaaaacugacgaagacauuucacaguauuuaaauggggagcugagcccagcaguacuaaacgcccuccuggagaaucuuaguuuugauaaguucaucagauugucucugcagucccucgcuaaaauccugccguuaauggaacaaggacugagguacgacgaggccuguaagcagguuuauggcgaucauuacggcaagaaagaacagcuugaguugcguuuccuccccaagauuccuguggaggacauacggaacccagucgugcugcgaacccuaagccaggcaagaaaagugaucaauggggucguuaggcuguauggaucgcccgcgcgcauucacaucgaaacaggucgggaggugggcaagucuuuuuccgaaagaagggauauaucaaaacgccaagaggaaaaccgaaaugagcggcagcgugcuguagagaaguucaaggaauuuuucccucauuuugugggggagccaaaagccaaggacauucucaaaaugagacuguacgaacagcagcacggaaagugccuuuauaguggcaaagaguuggaucugaacagguuacucgaaaaggguuacgucgagaucgaccacgcacugcccuucagccgcacuugggaugacuccuuuaauaacaaagugcuuguucuggccucugagaaucaaaacaaggggaaucagaccccguacgaaugguugaacggcaaggagaacgcugaacgguggaaacucuuccaggcccuggugaauggaagcagauuuccuuauucaaagaaacagaggauccuaacaaaguaccuggaugaggacggcuuccgagaacgcaaccucaaugacacccgguaugucgcaagauuucuguguaacuucauugaggauaauaugcaacuuguggggcaggguaaaaagaggguauuugcuaguaacggacagaucacggccuugcugcgucgcuccuggggcauucaaaagguucgggaggacaaugauagacaucacgcgguggacgccgucguggucgcuugcagcacuagggcauuacagaaaaagauaacagauuacgugcgauauaaagaaaugaacguuuucaccggggagaagaucgaccaggaaacuggagagauuaucaaauuccauuuucccgagccauggaaguucuuucggcaggaaguggagauccgcguauucucugaaaccccugccgaggaugucgugauugcucuccccgacagaccacaagccaaucacgaauuuauacagccccuguucguuucaagggcaccuacacggaagaugacgggccagggucauauggagaccaucaaaagugcgaagcgacuugccgaggggcugagcguguccagagucccacuaacacagcucaaacugaaggauuuggaaaacauggugaaucgcgagagggaaaaagcucuguacgaggccuuaaagguacgucucgaaaaguuuaacaaugacccggcaaaagccuucgcugaucccuuuuauaagaaaggcggacaacaggugaaggcaguucgggucgaacaggugcagaaaucuggcgugcuggucagacaagagaacgggguugccgacaaugcuucgauggugaggguggauguauucauuaagggagguaaauacuuucuugucccuaucuacacuuggcaaguggcgaagggcauucugccaaaccgcgccgcaacccaggggaaggaggaggaauauugggacaucauggacgagacagcuauauuccaguuuagcuuguaccagaacgaucucaucaaacugguuacuaagaaaaagaccauuuucggauauuucaauggccuaaaccgagccacauccaauaucaacauuaaagaacacgaccuggauaagucaaaggguaaagacgggaucuaccuugaggugggcgucaagcucgcccugaguuuggagaaauaucagguggaugaacugggaaagaauauacagcccuguagaucuaugaaaaagcggccuccaguuagguga

SEQ ID NO: 2651 - RNA, 3171 nt, Artificial Sequence
  Cas9 variant
augcccaagcagaaaagcaccagauacaggcuggcccucgaccuuggcuccacaucucuggggugggcuguguugcgguuaaacgagcaacacgaaccuaaugcaaucauucgcgccggaguccgaauauucucaaacggucguaauccaaaggauggcaguagccuggcgguuacuagaagggcugcccgggcaaugcgcagaaggcgggaccgccuacucaaacgaaaggccagaaugaugaacaaacugguggaguauggguuuuucccggcugauguagcagaaaggaagaaacuugagcggaucaaucccuacgaacugcgugccaaaggauuggacgcuccucucacgccaggcgaguuugcccgcgcgcuguuccauauuaaccagagaagggguuuuaaguccaaucggaaaaccgauaagaaagagaacgacucuggggcacugaaggccgcuaucucgcaccuccgacagcaguuacaugaacgcaaggccagaacagugggagaguggcuguggcaaaggcuucaggcaggcuugggcacucgggcucgcuauagagaaucaagggucgcccaggcgaaugggaaaacccguauugaaaagagcuacgaucuguauguggaccggcagaugaucgccgaggaguucgaugcacuaugggcugcccaagcugccuuuaacccccagcaguucagugagcaggcacgaggagaacucagagacguucugcuuuuucaaagggaucugcgcccugugcggccagguagaugcacauugcuccccgacgaggaaagggccccucuggcuuuaccauccguccagcgcuuccgaauacugcaggaggcgaaucaccuccggcuucugcauccggauuugcgugaggaaccccuaucucuggcacaaagagacgccgugguagacgcucucgagcacaacagcaaaaggaccuuugaacagcugcgcaaacuucugaaguugaauggcacuguuaaguucaaccucgaggaugaaaaacggaaggagcugaaggggaaugccacauccgcaaccuuaucaaaagacggacuguuuggcgagaacugguggaaccuagaugaagcccuccaggacgcuaucguguggcagcuggucagugagcaaagcgaagagaaacuucagaauugguugcaggccaacacgggugugaaugcaacucaggcggaaaccauugcuaacgccgggcugccugagggauacggcucucucuccuauaaggcacuggccagaaucauuccagcucuuaggggcacagagguggccaaugggaucgaugucccccgaacuuacgaccaagcaguucaggcugccggauucgcgcaccauucagaucuggacagcgguuucgauuuugaacacagucaugacgagguggaacgcauaggcgagcggguaauugccucuaccggggaggugaagccugucuucgcuuuuaaacaguugccauacuauggaaaggcacucagaaggcacguggccuucgcuaaggaacacccccguaacgaggaggaacgcuacggcaaaaucgccaauccgacaguucauauuggucugaaccaguuacggguggucgugaaugcacugaucagaagguaugggcgaccuaccgaaguaguuguggagcuagcgcgggaucucaagcaaucccgcgagcagagacaggaggaacagaaaaggcaagccgacuaccagaagcggaacgaacacauccgaagagagauugcuagcaugcauggcugugccgaggaacgcgucucgcacgcagacgugcagaaauggauacugugggaggaacuuucuuuugaugucgcugacaggcguugccccuauuccggagugcaaaucucagcccagauguugcugaguaaucagguugagauugaacauauccucccauucagccagacgcuggauaacuccuuaaauaaccggacuguggcaaugagacaagccaauaggauaaagggcaaccgcacaccuuggcaggcucgagaggacuuugaaagacagggguggucuuacgauagcauucugcagcgggcggagaggaugcccaaggccaaacgcuaucguuucucaagagacggauacgagcgguggcuuaaggaagauaaagacuuuuuggcaagggcucucaacgauacccgcuaccugagucgaguagccaagacuuauauggagcuagucuguccacuggguacaagagugauccccggccaaaugaccgcccuccugcgggcuaaauucgggcuuaaugacguuuugggacugaacggcgaaaagaauagggaugaccaccgccaccaugcaguggaugccugcgucaucggugugacggaccagggguuacuccagagauuugcgcaggcuuccgccgacgcaaggggcaacggacuggagaaacuuguagagaauaugccugugccaugggccaccuaccgggaucacguuaagcgugcuauucaauguaucugggucagccauaagccggaccacggcuaugaagggcccaugauggaggaaacagcauacgggauucgcaaagaugguucuauacgacagaagacuaaagccgacggcucaaccgggagagagaucacacaccugauuaggaucacugaaccuacccagaacuugcggcauggaguggaugcgcaaggccagccacucgcuuauaaggguuacgugggaggcaguaaugacugcaucgagauuacacagaacgagcagggaaaaugggaaggcaaugucauaaccacuuuccaagccuaugauaucguucgcagacuggggagcaagcagggacccaggcggcuacgacacccuacgcuggcacagacacucgacguguacggcaagccaaagaagcuggugaugagacuuaugauugaugacuguguacgcuuggagcuggaugguaacaaaaagaccuuaagggucgugaaaaucacugggaauggacagguuuuuauggcccccgugcaugaagcuaacgucgacaagcguaauuccgauaagaccgacccguucgccuacgugucuaaauaugcaggcucguuccaaaaggcuaaagcccggagaauuacaaucagcccuauaggugagcuccacgacccaggcuuuuga

SEQ ID NO: 2652 - RNA, 3174 nt, Artificial Sequence
  Cas9 variant
augagcgacaaguccaaaauccugggcuucgauauugggauaaccucuaucggaugggccuacguggagggugaagaacucauugacugcggcgucagaaucuuuacaaaggcugaaaaccccaaaacuaaggagucacuugcacugccuaggcgggaagcccgcgggguucgacguagauuggcgaggcggaaaggacgcuuaaaugcuauuaagcagcugaucuguaaggaguucggccuaaacuaucaagauuacauagcccaggacggugagcucccaaaagcauaugccgggaagcugaucaauccguacgaacuuagaaguaaagcucugagggagaaguuggaaaaagaggagcucgcacgggugauucugcacaucgccaagcaucgcggauauggcaacaagcacgcuaaagaaacggaugacgccgagagcggcaagauuaaaaaggcgaucuccaauaacgaaaagauacugaaugagaagggguaccagucugcaggagaauaucucuaccaggaguuuuuccaaaaagagcgauuacaggaagagaagaaggguaacaauaccacaaaagaauuuaagaacguaagaaauaaagccggcgauuacgagcauugcauugcucagacucagaugcaaaacgaacugaggcuuaucuucgagaagcagcgggaguuuggguugaauuucucggaagaguuuaaaaagaaggugcuggaaaccgccuucuuucagcguccccuaaaagacuucucagauaagauuggagacuguacauuuaucgagggcgcaaaacgcgcuccuaaggauagccucagugccaucgaguucgucgcgcuggguagaauuauaaacacccuuaaaaaucugcagaacacuuccggggagguguauucuagggacaagaucaacgagauuuugcaaaucguucucgauaagggagaaauaagcuacaaaaagcugcgggagauuuuagacaucgaauccucagugcgauucaaagacaguaagcuggauuauacaaaagagcucaaggaggccgaaaagaccaaacuuuuugagagcaagaaucugcagaaauucaagaaagcauugggcucuuuugaaggcaucucccgcgagauucuagacucaaucgcuaaggaaauuaugauaacgaaagauaaggagaagcuggccaaagagcucaagaaauucccacuggacgaaacucagauccaaaaccuuagcaaucugaguuuuucucagaccauuaacuugucccucgaggcucugagccagaucuuacccuucaugagaggggaaagggaggauaagugccugcgguacgacgaagccgucgagaaagcaggacuaaaggagguggccaagaauaaaucgaaggaugacuuucucccuccacuggaaaacuaugagcccuaccuugcuaauccuguaguugcgcgcgcauugucugaauauagaaaagugcugaacgcccuccugaggaaguacgguaaaaugcacaagauccauauugaguucacacgugaagucggcaaguccaaagaggagcggaauaagauagaaaaagagcagaaggaaaacuuugcuaaaaaucaagaggcccagaagcagugugagauccuugggcugccaauuaacggagcaaauaucuugaagaugaaacucuggcgagaacagcaagagucaugcguguacaguggcaaggaaauugccaucgaugaccugaaaaacccggcuauauuacagguggaucacaucuaucccuacagcagauccuucgacgacucuuauaauaacaagguccugguuuuuagcaaagagaaccagaauaagcuaaacaaaacuccuuucgaagccuuuggugagaauaaggauaagugggagaaaauucucucacuggcaaguaaacuuccaaaacccaagaggcagcgcaucuacaacaugcaauucaaagacaaggaacagggguucuugacccggaauauuaacgauacaggcuauaucgcgagacuggugucccaguggaccaagaauugucucagcuuugagaaacugucugaagacgagguaucaauagcuggagaaaagggcaguaaagugcacgucgaggugauuagcggguccuuaacggccaugcugaggcauuacuggggacuuggugauaagaaccgcgacaaucacuugcaucacgcaguugaugccaucauuaucgcuuauucuaacgagaaagugauaaaggccuucucggacuacaagaaacaccgagaacagaauaaggcaaaauuuuacgcuaaggagaucgccgaaagcgaguauaaaaagcaaaaggucuucuuugaaccuacuaaccauuuccggcagaaagugcucgagaagauugauuccaucuuuguaucaaaaccaccccguaagagagcgaggggcgcccugcacgaggaaacauucuacaguuuugagcgccuaugcaaugacaaagaauaugcuaagaaggagaaaauggauuacgggggaaaggcaggcauucagaaagccaucgcucuggguaagauacggcaaguugggaccaaaauugugucuaacggcacuauggucagaguggacaucuuccagcauaagagcaauggaaaauuuuauggcgucccgaucuacacaauggauuucgcccucggggugcugccuaacaaggcaguuguguccggaaaggacaaacaggguguaauuaaggacuggcuugagauggauucaaacuaugaauuuuguuucagcuuguucaaagacgaucugaucuuaguccagaagaaagagauggaaaaggcggagcucugcuacuacaccgacuuuaauucuaacacggccggcauuaaguucgaaaaacacaauaaccuguaugugaaucuuaacgagaaugagaggaagcuguuuaccuccaaagaaguugugaaagggggaaagaagaacgucuggaaggauaaaacacccaaggagauagaacaauuggagaaaaaucgaaagaucauuggcgguuucgugacuaucgaagaccucaaaaccuuugagaaguaccagguaaguccacugggggaggugcagaaggcugauuucgccccucgccaggcaauuacacuaaaaagcucucccaagcaucggaucaacaaauga

SEQ ID NO: 2653 - RNA, 3174 nt, Artificial Sequence
  Cas9 variant
augagcaacagagugcccuacaggcuggcccucgaccuuggcaccaauuccaucggguggugccuguuggauuuaaacggaaauggugacccuuguggcguccggcgcauggggguucgaauuuucccagauggacgugacccgaagucuaaagagucacuggcugcagauagaaggcuagcccggaguaugcgcagaaggcgggaccgcuaucuccgaagaaggagcgcgcugaugaacgcucuuguggccgcaggccugaugcccgccgaucgggcuacacguaaggcauuggaauccgaggacccuugcgaacuccgcgccagagcucuguuugagccacugacugccggucagguagggagggcgcuuuuccacuuaaaucaacggcgaggauuuaaaucuaaccgcaaggcagccggcgaagagaaugaggcuggcaaaauaaaggccgggaucucggcacugaaggcugaaauugaggccucaggagaaacgacccuuggugcgugguuggccgcaagacauaggaaacgggagacagugcgcgcuagacuggauggcgccggggcuaaggccagcuacgaguucuaucccgaaagggggcuaguccacgacgaguuucaggcaauccguacugcccaggcucuccaucacccugcggugaccgcagaacagugggaucggguugagagugugauuuuccgacaaagaccacugaggcccguccgcccuggcaaauguacacuuuuuccagaccaggaacgggccccgugggcucugcccguggcccaggaguucagaaucuugaccgagauagguaaccucaagcuguacaggccuggggaagaaccacgcgaauuauccgcagaucagcaugcccaacuguuugcuaaacucugccgaucugccgaccuuacuuucgagaagauccggaaggaacugaaauuggaccccggacuaaagguaaaucuggagggcgagaaacgugauagacucaagggcgacgcaguuacaagcgcgcuguccgcuaaaaagagguuugggccuaaauggaacgcccuuaccccagaugaccgccgggauauugugggaagacugaucgaagcagaggacgaagccgaguuggcugguuggcucgaaucaguccacggccugcccagugagaaugccgcacacacggcugccagcccgggguuaccugauggauauuguaggcugucugagaaggcgcuagugaagcucgugccccugaugcgagaacagcgccuucgguacgacgaggccgucuuggcucugaaccuccaucacuccgauuucagaccagaaggccugcuugacgagcugccuuauuacggugagcccuuggaaagguuuauugcauucgggucaggcgagccaagcgaucccccugaacagcaucucggacguuucccaaauccgacuguucacaucggccugaacgaguuacgcaaacuggugaaucggauaguagaaagaugggggaagcccgccgacauuguggucgagcuagcuagggaccucaaacgaagucgggaugagcgcgacaccauccagagagaacaagcccagaaccagaggaagaacgaggaucgguuugcaaaaauuaaggaacugggaaucgacccucgaccagauucuaugcuuagauugcgccugugggaggaacuccccaagguggguguuggccacgugugcgucuacacaggggagccuaucggaauuaggcgucuguuagagggcgacguggauauagaccauauccugccauucucccggacucuuagcgauggugcggacaauaaaauuguauguguuagaagggccaaccgcuuuaagcgagauagaucgcccugggaggcuuucggggugaccgccgucgacggcuaugauugggcagcuaucgcccaacgggcagaggaauugccgaaaaauaagagguggcgcuuucucccugacgccauggaccguuucgagggagaaagaggcuuucuggaucggcagcuaguggagacaaggcaccugucucgcgucgcucgacaguaccucgcguccauaguggaccugaacaaaguuagaguggccccagggaagcucaccgcaauguugcgggcuagguggggacugaauaagauuuuaucagaugguaaccucaaaaaucgcagugaccauagacaccaugccaucgaugccgcuguacugggcaugaucgaccagaggcuuguccaacugguggcacaggccgcggcucgggccgaggcaaacgaauuggagcgucucuucgaugggcugcccgacccuuuugauggacuagccgcuacgagcuucggcgaccagguucgcgaaaagauucgagguaucacugugucccacagagcagagcacggguggcagggcaggaugcauaaugauacagccuauggacccgucgaggcggugaacggcguacacaccgugguuacucggaaaccacugucugggcucacagcuaaggacuuuccuaauauucgcgauagaguccuggccaaagcacuugaagaccauguggccgcugaggccgcagcuggaaggagcuucggcgacgccuuggguucauuuaaguggggaggacaacccgugcggcgagucagaaugcuggauguuuuaggcaacccaauaccgauccaggacccuagugguaccguguucaagguguacaaaggcgauuccaaugcgugguaugaaauucuccgcgaccccagggggcgguggacgggaaagaucguaagcaccuucgaggccuaccgucugcacagagaauggcuugcagagacaggcggggauucuggaaggggcucaggugucuuucuggacugggcugccaaacgcgugguuggggaggcuggaacuccacuauuccggcucuuuaagggcgaucuguuggcacugggugaagcccccgaccgaagaaucgugagggucgugaaauucagugagggccagguugccuuagcucuccaccuggaagcggggaaccuuaaggcacgcgaugccgacaaaggagauccuuuuaaguaucaguacugcagcccagacucccugcggaagcaagcugccagacccgcaggcguggacuugcucggguacguacaugauaaaggaccucuggaguga

SEQ ID NO: 2654 - RNA, 3174 nt, Artificial Sequence
  Cas9 variant
augagaaggcugggccucgacauugggaccaacagcauuggauggugccuuauagaggaugacaagaaaaucguggauauugguguccggaucuucuccgacggccgcgaucccaagucuggggccucacuggcuguugaccgacgugaugcaagagccaugaggcggcgcagagacagguacuugggacggcgcagugcguuuuuacaggcucuggugguacacggccuaaugccugccgaugcagacgaagccaaacucguggcugaucgagacccauaucaacugagagcaaaggcccuucaugucgcucuggagccguucgaaauugguagggccuuguuucaccucaaucagcggcguggguucaaaagcaaccgcaaggcggauagaaaggcaaaugccggagaggacggcaaaaucgcugaaggcgccaaggcacuggaccaggcuauguccgaggccgggguggauacacugggacaguuucucgcguuaaaagagacuaagaggguucggcuggguucugacggccaagccuacgauuucuauccccagcgacgccauauagaauacgaguuugacagaaucuggaaagugcagucggaauaucacccugcacuuuugacggaggcugccagggcugcccugcaucggauucuauucuuucagcgcccacucaaggcacaagaggucggguucuguaccuuugccggagugaacggcaucgcugcgaaugaaagaaggcugcccaaggcacacccucuuuuccagcagcgucggcuguacgaggaaguaaaccaguugcgaauuguuucagccggugcugccgauagaccacucacacuggacgagagggaucgcuuaauccugcggcuccaagacagaaagaaggugagcuuugauacucuugccaaaaaggaccugagguuggcagauggggaacgcuucaauaaagagagugagaaccgaaaggaacuaauaggagacgagguccgggcugaaauguccgacaaaaagcguuucggcaccagaugggugcacuuuggccuggaugagcagcucaggauucuggccaaacuucaggacgaagagaaucccgaggcacuguuggauuggcuccgcucugaauaugggcuggacgaggcggcugccgaaagcguggcaaacgcccgguuaccugagggauacgguagauucggcgaaacagcuaccaggcugcuacucgaugcccugaaagcagaggucaucacuuacgacaaggcugcccuucgagcguuugggcaucacuccgauuuccgcacaggagagguuuuggaccggcugccauauuacggcgaacuccugaccagagagauugccccggguaaacccgaauauggggauccucuugagaggcaauacggcaagaucacgaauccaacugugcauaucggacugcgucaguuggagaaacucguaaacgcugugauugcaguccacggccgccccgaccagauagugguugaacuggcccgggaguuaaagcugaaugaaaaggagaaagaugaacacaagagaaggaucaaacgagacaccgaugcugccauugcacgggggcgcaagcuagcgucagagggauuuaucgacaacggugccaauagaaugcucaugaggauaugggaggaacugaacccugcuaacccacuugaccggcgaugccccuauugugccgagccgauuggcaucagagcauuguucaguggggaagcugauaucgaccauauuaucccuuacagccgcucucuggaugacaaugugggaaacaaagucguggcccacagguccugcaaucgugcaaagggcaacaagacacccuaugagaaaugggguccacauauugauccugaacggugggagagaauaucagaccagguagccaggcuccacaagagcaaacaauggcgcuuugggcccgaugcuauggagcgaaucgacagagauggcggauuccuggcgcggcaguuaacugacacccaguaccugaguaggguugccggcaaguaccuucgcucuuuguauccaacagcacaguccgggcguguggaugucauucccggaagaaugaccgcuaugcuccggaggaaauggggucugaauagccuacugccugaccauaacuacguggaaaaugagcacucgaacgccccaaagaaucgccucgaucaccgacaucacgccaucgacgcugcagucgccgcggugacgacucugucucuuaugcaacagaucgcugacgccgcaggcagagccgaagauaagaacuuggaccggcuguuugaggauauuccgcagcccuggccuggguucagggaagaguuaggagaggcucuccgcuccacaaccguuucacauaaagcagaccacggcagaaagaggcggccaagucgugaucgcgacgugacugccgcgcgacugcacaaugauacagcuuauggucuuaccggggacguagccgcagauggcaaaacgcccauagucgugcauagaguuccucuggccagcuugaagccagcugaccucaucgauccccugaggauuccggacccugugcuacgggacgcccuguacgcagcuacccgcgauagaacaggaaaagaauuugagcaggcccucacucaauucgcgaggcaccauccacuguuuaagggcauccggcgagucagagugcgcgaaccccuuaacguaauuccuaucagggacgccgcagggcgggcuuauaaagccuacaagggagaugcuaaugcacguuucgacguguggagauugcccaacggcaaguggguuuccgauauagucucuauguucgacgcccacuguauggccgauaaaagcgacaggcgcccacauccugcugcgaagaaagugcugucauuacggcagaaugauaugguggcaaucgagcgaaguggugucacccagauugccagaguugugaaguuuuccacaaacgggagcaucgcucucgccgcagacaacgaggccggagcucugaaagcgagggaugccgcacccaaugacguggauccauucaaguauaucuuuucuucaggcgguggccuuaagaaccugaaagcucgccagguacgggucgacccgcuagggagaguguucgacccuggaccccgugaauga

SEQ ID NO: 2655 - RNA, 3177 nt, Artificial Sequence
  Cas9 variant
augaagaacagcuacauccugggccucgacguggggauugccuccgucggauauggucuuauacacucugauucaaaaaguguuaucgacgcuggcgugagacuguuccccgaggcaaauguagaaaacaaugaggggaggcgggccaagcgcggaagccgacguuugaaaagaaggcggauucaucgcuuagauagagugaaguaccugcuagcgcaguaucaccucaucauugacgauaaaaucccuaaguccaccaacccauacgcuauaagggucaagggccugucuucggcccuuucaaaaagcgaacuggugaucgcauugcuccaucuggccaagcggcgcgguauucacaauguuaacguggucauggacgagaaugaaaguacaaacgagcuguccacuaaagagcaacucaaggaaaaugcuaaacaguuagagaaccgauaugugugcgaacugcagcuugauagauugaaugagcaguacaagguaaggggagagcggaaccguuuuaagacggaagacuucguucgcgaggcaagacaaauccugaccacacagcagaaauaucaugauauugacgaacacuuuaucgagcaguacacucaccuacucgaaaccaggcgggaguacuaugagggaccgggcaagggcucucaauacgggugggaaggagaucugaaacagugguaugagaugcuuaugggucgauguacauacuuccccgaagaacugcgcagcgugaaguaugccuacaccgcugacuuguuuaaugcccucaacgaucugaauaacuuagucauagcgagagacgaaaacgagaaacuggaguauuucgaaaaguaccauauuaucgagaauguguuuaaacagaagaaguccccuacucucaaacagauugcaaaggaaaucgacgugaaagagucagauaucaagggcuacaggauuacaaagaacgggaagccacaauucaccaguuuuaaacuuuaucacgaccugaauaaaauauucuuggauaagaaaaaccuagaaaauaucgagcugcucgacgagauugccuuuauccugacgcuuuaccaggauccccugagcauaaaggaagcauuggaccagcuccaagaucuguuaacugagucugaaaaagaggccauugcacaucugaacggauauaccggcacacaccggcuaucccucaagugccugcaccuuuugaucgacgagauguggcagacuucacgcaaucagauggaagucuucaccgcucugaaccucaagccucagaaauaccaacugagcaagcagaaacagaucccaaagaaaaugguugaggaauuuauucuuagucccgugguaaagagaucuuucauccaguccauugagauagugaauacaaucauuaagaaauauggucugccugaagagaucaucauugaguuggccagggaaaagaacagcgaggaucgucggaaauuccucaaucgaauacaaaaggaaaacgagaauaccagaaaacaggucgaagaggugaucagggaguacgggaaccgcaaugcgaagggacugguugagaaaauuaaguuacaucagaugcaggagggcaagugucuguauucgcuacaaaacaucccacucgacgaucugcuucggaacccgucucacuacgaaauugaccauaucauacccagauccgugucauuugacaauaguuucaacaauaaagucuuggugaagcaggaggaaaacagcaaaaagggcaauaggacgccuuaccaguaucugaacuccaaugagucuguacucagcuacguucaguuuaaacaacacauccugaacuuaucaaagaguaaggagcgcauuuccaaaaagaaacgagaauaucugcuugaggaacgggauaucaauaaguucgaggugcagaaagaguuuauuaaccguaauuuggucgacacuagauacgccacaagggaacucgugcagcugcuaaagagcuauuucucugcaaacgaucuggacgucaaggugaaaaccaucaaugggucauuuacuaacuaccuccgcaaggcuuggaaauucgauaagagucggaauaaaggauuuaagcaucacgccgaggacgcucugauaauugccaacguuagcuaucuuuucaagcaauccaaagaauugaaggaggcaaacgccauccuggaaaauaacaauuuaucucucaacaaaaauaaggauucgaaaaaccugcuuacagagcaggacuacagaaagauguuugagauuccaaaacaggugcaggauaucaaggacuacaaggauuucaaauauagccacaggguagacaagaaacccaaucgacaacugauaaacgauuccuuguacucaacccgcgaagucaaugagaaccauuauaucgugcagacgguuaaggacauuuacgcuaaagacaauaccaagaucaaggaucucuuucugaaaacaccugaaaagcuacugauguaucagcacgacccacagacuuucgagaaacucaugcuggugauuaagcaauacggugaagagaaaaaccccuucgcgaaguauuacgaggaaaauggcgaguaccuuaccaaguaugcuaaaaacgaaaaggggccgacaaucaaacgguugaaguacauagggaaaaaggucggcacucaucuggauauuaguaccaauuuuucuggugccaagagaaaagugguacaguuaagcaucaagccuuucagguuugacguguuccacuccaaagcuggguaucacaugcucacacugaccuacauggauaucaagaaaaaggagaagcauuaucagauucuuaaaaacgaauaccaggcccugaaggagcguuauaaaguucccucagacgcacaauuuaucggcagcuucuacuacaacgaucuaauuucuauaaaugacgagcucuuucgcgucaucggagugaacaauuccacucggaacguggucgaacugaauaugguugauauuaacuauaaggacuacugcgauuugaugggcaucaaaaagacgccaagaauuuucaaaacaaucaccaagaagacugggaaaauagagaaguauaguaccgacauccugggaaaucaguuuaaagugaagccuagcaaaucuccccaguuaauuuucaagaggggugugcucuga

SEQ ID NO: 2656 - RNA, 3180 nt, Artificial Sequence
  Cas9 variant
augagaaggcugggccucgacaucgggaccaacagcauuggauggugccuuacacagggucccggcgaugaggccgacgggauaguggauaucggaguccggauuuucuccgacggccgcgauccucaaucugguacuucacuggcuguugaccgacgugaugcaagagccgcgaggcggcgcagagacagguacaucgggcggcgcagugccuuuuuggauacguuaguggcccacggacugaugccagcagacgccgaugaagcuaagcuaguagcagcccucgacccguauacccugcgagcuagagcccuugaggcgccccugacaccucaugaaauuggcagggcauuguuccaccucaaucagcggcguggcuuuaaaagcaaccgcaaggccgagagaaaaacuaaugaugcugacgacgggaagaucgccaccgcagcuuacgcccuggauagggcgaugcuggacggagguuucgauacacucggccaguuuuuaaacgcccaggaaaccaaacgggugcgaauggacggggaggcacaaggauaugauuucuacccacagcgcagacaugucgaguaugaauuugacaggauauggacugagcaggcuaagcaccaucccgcccugcuuacagaaaccgcucgguacgccuugcaccgcauccuguucuaucagagaccucuaaaggcacaagugguuggcaaauguacguuugugcacuccgaggauaggcucgccaaggcucauccacuguuccagcagcgucggcuuuacgaggaagucaaucagcuggaggugacuacccccggugaagcgaaccgaaaauugacacucgacgagagagauaggcugguacgcgaauuaucucacaagaaagcaauugccuuuacuucgcuggcugccaagaucaagcucgagccugggcaaucauucaauaaagcaagcgagacccggacacagcuugccggagacgaaguuagagcugugcugggcgauaagaaaagguuuggcccagccugggagcauuucgaccgcgaccgacaguggaccauugucgaacgguugcuagaggaagaggauccggacgcacugcacgcguuccucacgcaagauugcgggcuggacgaugagcacgcugccgcaacugccaagacaagucuucccgaaggauacggucgucugggcgcuaccgccacugcaagaaucuuggcugagcuccaggccgaagugauaacauaugacgaggcggugaggcgcuguggguggcaucacuccgaucaucggaccggagaaauucugccucaguuaccauacuauggcgagcugcuaacgagagacauucccccugguacccaggauccaaacgaucccccggagaaaaggugggggcgaaucacaaauccuacuguccacaucggccucaaccaaguucgccagcuggugaaugccaucguagcugugcauggacggcccgaccagauugucguggaacuugcaagagaguugaagcugaacgaaaaagacaaggaggagcacaauaggcguauacgccgggauaccgccgcugccaucaagagaucugaaaaacucacacaggagggcuuuccagacacuggggcaaacaggaugcugcuucgacugugggaagacuugaauccugcgaacccccucgaucggcgcugcccauacuguggagcccccauugguaugagagcucuguucgccggcgaggcagacguugaucacaucauaccuuauagcagguccuuagacgauucagcugggaacaagguggucgcccaucggaguugcaaucgagcaaaaggaaacagaaccccauacgaaaaguggagcgacgauccggaccgcugggaugccauuacagcucaaguggcgaggcugcaccguucuaaacaguggcgguuuggccccgacgccauggcaagaguagagaaggaugguggguuccuauccaggcagcucaccgacacucaguaucugucacgccuugcuggccgauacuugagcagucuguacccuacgaaggaggaaggaucuguuuaugugaucccaggcagaaugacagccaugcuccggaggcuguggggguuaaaugauauccuguccgaccauaacauugucgagaauaaacacagcaacgcccccaagaaucgccuugaccaccgucaucacgcuaucgaugcagccguggucgcggugucgaccagaucuuugaugcaacggauugcuaggacugccggacaggcagaagaccgcaaccucgaucgacuguuugagggucuagacccuccauggcccggcuucagagaucagcugcgggacaggcuccuggccguuaccgugucccauaaagcugaucacgggcgcacaggaaccccgguaccuggcaaggacgcaacugccgguagacuucauaaugauacagcguacggguugacgggcgaaaccucagcuaaaggacugccaauagucgugcacaggguucccuuaacaagucucaagccugccgacaucacugaucccgaccggauuccagacccugugcugcgugaugcaaucgagcgcgccaccgcuggcaagauggggaaagacuuuacagaugcccuugcaaaguucggacgaagcggcgcucaggagacugacagaaaaggugaaaggcuguuucgggggacccgcagagucagggugcgggagcccuugggaguaaucccaauugccgaugcguccggccgaguguauaaggccuacaaaggugacucuaacgcaagauucgauguuuggcgccucccggacggcaagugggucagcgauauagugucaauguuugacgcucacaggccugaucaaggggaccggcguccccauccagccgcuaagaaagugcugagucuaagacagaaugauaugaucgcaauugaaagggacggagcuccccgcgagaucguccggguugugaaguucuccacgauuggcagcgugcagcuggccgcuaccacagaagcggggccucucaaagcacgagacgccucuccacccgauguagacccuuuuagauauaucaacucaagugcuggaggccugaagaaaauaaaggccaggcaaguccgcaucgauccgcuuggucggauuuucgacccagggcccagauga

SEQ ID NO: 2657 - RNA, 3180 nt, Artificial Sequence
  Cas9 variant
augaucgagaggauucugggcguggaccucgggauaagcucccuuggaugggccaucgucgaauacgauaaggacgaugaggcugcaaacaggauuaucgacugcgguguucggcuguucaccgccgcggaaacacccaaaaagaaagagucuccuaauaaggcucgccgagaagcccguggcauuagaaggguguugaaccggcgcagaguaaggaugaauaugaucaaaaaguuauuucugcgggcagggcuaauacaggauguggaccucgauggagagggcgguauguucuauucaaaggccaaccgcgcugacgucugggagcugcgacacgaugggcuuuacagacuguugaaaggagacgaacucgcaagggugcugauccauauugccaagcaccggggcuauaaauuuaucggcgaugacgaggcugaugaagagagugggaagguuaaaaaggccggagugguccugcgucaaaauuucgaggcggcagguugucgcacugugggcgaauggcucuggagagagagaggggccaacggaaagaaacggaauaagcauggcgacuacgaaauuagcauccaccgagacuuacugguagaggaaguugaggcuauauuuguggcccagcaggagaugcgcuccacgauugcaaccgaugcucuuaaagccgcguauagagaaaucgccuucuuugucaggccaaugcagcggauugagaagauggugggucauugcacauacuucccggaggaacgcagagcacccaaaucugcuccuacugccgaaaaguuuaucgcuaucucgaaauucuuuucaaccgugauuauagacaacgaggggugggagcaaaagaucauugaaaggaagacauuggaggaacugcuagauuucgccgucagccgugagaaaguugaauuucggcaccuccgaaaguuccuggaccuuagugauaaugagaucuucaaaggacugcacuauaagggcaaaccaaagaccgcaaagaaaagagaggccacuuuguuugaccccaacgaaccuacagagcucgaauuugauaagguggaggcugagaaaaaggcguggauaucccugaggggcgcagccaaauuacgcgaagcucuggggaaugaguuuuacggacgguucguagcccucgguaagcaugcagacgaagccaccaagauucuuacguacuauaaagaugagggccagaagagaagggaacugacuaaauugccacuagaggcugagaugguggaacgccuggucaagaucggguuuucugacuuccucaaacugagccuuaaggccauccgagauauucugcccgcaauggaguccggagcgcgguacgacgaagcuguguugaugcucggcguuccucacaaggagaaaucagccauccugccaccguuaaacaagaccgacauugauauacugaaucccacagugauccgugcauuugcccaguucagaaaagucgcuaacgcccuagugaggaaguauggugcauuugaccgcguacauuucgaacucgcucgggagauuaauacuaaaggggagaucgaagauaucaaggagagucagagaaagaacgaaaaggagaggaaggaagccgcggacuggauugccgagaccagcuuucaaguuccucugacacgcaaaaacauacuuaagaaacgauuguacauccagcaggauggccggugugcuuauaccggagacgugauugagcuggaaagacucuucgaugagggcuacugcgaaaucgaccacauucugccaaggucucguuccgcagaugacucauuugccaauaagguccuuugucuggcucgcgccaaccagcagaaaacggaucggacucccuaugagugguucgggcacgacgcagcgagauggaaugccuucgagacaaggaccagcgcuccuaguaaccgagugcggacuggaaaggguaagaucgaucgcuugcucaaaaagaauuuugacgaaaacucugagauggccuucaaagacagaaaucugaacgauacaagguacauggcacgggcuauaaagaccuacugcgaacaauauugggucuuuaaaaauucccauacgaaggccccagugcagguucgaagcggcaaguuaaccucggugcugagauaccaaugggggcuagagucuaaagaccgcgaaucccacacacaucacgcaguagaugccaucauuaucgcuuucucaacucagggaaugguccagaagcucagugaguauuacagguuuaaagagacccaucgugaaaaggagcggcccaaacuggcggugccgcuugccaacuucagagacgcaguugaagaggcuacaaggauugaaaauacugagaccgugaaggagggcgucgaagugaagcgcuugcugaucagccgaccucccagagcccggguaacaggucaggcccacgagcaaaccgcuaaaccauauccuaggauaaaacaggugaaaaacaagaaaaaguggcgccucgcacccauugaugaagagaaauuugaauccuucaaggccgaccguguugcgucugcuaaucagaagaacuuuuacgagacuagcacgaucccaagagucgauguguaucacaaaaaggggaaauuccaucuggugcccauuuacuuacacgagaugguccugaaugaacuuccuaacuugucacucggcacaaacccagaggccauggacgaaaauuucuucaaguuuaguaucuucaaagaugaccugauauccauccagacccaaggaacuccgaagaagcccgcaaaaauuaucaugggcuacuucaagaacaugcauggggccaauaugguucuaagcucuauuaacaauucaccuugugagggauuuaccugcacaccagugaguauggauaaaaagcacaaagacaaguguaagcugugccccgaggaaaaccggaucgcugguaggugucuccagggcuuccuggauuauuggagccaggaggggcuucgcccuccacgaaaagaauuugagugcgaccagggagugaaguucgcauuggacgucaaaaaguaccaaauagauccccugggcuauuacuaugaaguaaaacaggagaagagauuagguaccauuccgcagaugcgguccgccaagaaacucgugaagaaauga

SEQ ID NO: 2658 - RNA, 3180 nt, Artificial Sequence
  Cas9 variant
augagcaagagacugagguaccggcucgcccuugaccugggcaccaacuccaucggguucugcuuguuagaucugaauggagacggucgccccuguggcgugcgacguaugggggucagaauuuuuccugauuucucuaaacuacagcaaucacucgcugcagacaggcggcuggcccgcaguaugagaaggcggcgcgaucgauaucuuagaaggcggaaggcgcugaugaacgcuuugguugccgcagcccucaugccagcugacccgaaagcacguaaggcccuggaggcucuggaucccuacgaacuccgcgccgcggcaguggccggaccuuuaccagcucaccagcugggcagagcccuuuuucauuugaaucagaggcgggguuucaaaagcaaccgaaaggcagcuggggacgagaaugaagccggaaagguaaaauccggcauaucugcgcugaaggccgagcuagcagcuucgggcgccgggacacucggacaguggcuggcugcccgccacgcaaacagacaacccgugagggcccggcuuacugguacgggcgcuaaagcgaccuauucauuuuacccugaacgcgcacugguccaugaggaguuccaggccaucagagcugcccaggcaccacaccaucccggggugacagccgaacagugggauaggauugagagcguuaucuuucaccaacguccuuugaagccagugaaaccgggaaagugcacucucuaucccgaagaggagcgggcuccuugggcccugccaauugcacagcgauucagaaucuuacacgaacugcauaaucucaggauaguccgccccggccagggugaggaagggcuuaguccugcggacuuugaucgguucuuugacagacuguguaggaagggagauuugaccuucaaaacacuagcuaaggagcugaaacucccacccgacgcccgcaucaaccuggaagacgauaagcgagaccggcuuaaaggcgaugcaaccgccgacgcucuguccgccgagaagggcaaacguagaaggauuggggcagcuuggcacucuuuuccggccgaucgccagcgggagaucgugggaagauugauugacgcggaagaugagggugaacucgccgcuuggcugguagaggaauuaggccugccuugggagguugcaauccuaacugccgagaggcccgggcucccagacggauacugccgacugagcgaaaaggcucuugagcaaguggucccuuugaugcaugaggaacaccuccccuaugaugaagccgugcgcgcacucggccugcaccauuccgaccaccggacaggugaguuccuugaugagcugccauacuacggguugccccucgaaagauucauagcguuuggcaccggagaggccgacgacccuccagaacugaggauuggccguuucccgaaucccacggugcaugucgcuuuaaacgagcugcgccggguugugaauagaaucauuaggcgaugggggaagccugaggaaaucguaguggagcuagcccgggaucucaaacagucacgcgcagacagagauaagacucagagggaacaagcugacaaccagaaaaagaauuggacccggacacagcagcugcgagagcuuggaauggaaccaacuggugaggccuugcugagacuccgccugugggaggaauuacccaggaucggcagugcacacgucuguguguauaccgggcaaccuauuagcaugacacagcugcuucagggagauguugacguggaucauauauugccauuuucucguacccucgccaacggcgcugacaauaaaaucgucugccaccggagagcgaacaggauuaagcgcaaccgaacgcccugggaggccuucggugugguauccgcagauggguacgacugggcugccaucgccgaaagagcugagucacugccgaagaauaaacgguggagguuucuaccuaacgcaauggaacgcuucgagacugagcguggcuuuauagauagacagcugguugaaacacggcaccucagcaggguggcccgcgaguaucugggauguauugucccacuugaaaaggugcgagcggcucccggcagauugaccgccaugcugcgggggagguggggauuaaauaguauccucucugacgcaaaccugaaaaaucgcuccgaucauagacaccaugccgucgacgcugcagugcuugguguuaucgaccaaaggcuggugcagcggguagccgaugcggcuaagcgugccgaggaaaaagaguuggagaagcuguucgacggccugccugaucccuuugaagggcuaccaggaccuagcuuccgcgaccagguccaggagcgagcacaaggcauuaucgugucgcacaagcccgaacacgguuggcaggggagaaugcauaacgauacugccuacggcccaguugagaggcugccggacggaacacaccggguggucacccgcaaaccucucggcucucuggcugagaaggauuuugggaauauuagagacagggcccuugcagcugccuuggaacggcauguggcggagcaggccgcacagggacgaucccugggcgaagcucuuucaugcuucacguggaccgguggggagguaagacgcgugaggaugcucgauaaacugggaagucccguugccguccaagacgaugacggccacacauuuaaguuauauaaaggugauagcaacgcuugguacgaaauacugcgggacggccgugggagauggacuggaaggaucguguccaccuaugaggcauaccgccuacaugccgaguggcucgccgaacggggcgacgggggacgaucugaugcugcguucccagacugggcagccagaaggcugugugcuggcauugguaagcccuuguuccgccuguuuaagggggauauguuagccuucggaacagcaccuaaucgggagaucaugaaaguggucaaguuuagcgaaggcagaaucguuuucgccggucaccgugaggcuggcaaccucaaagaaagggacgcggauaaggacgauccauuuaaauaccggacuugcucacccgaggcccugcgcaaggcacaggcucgaccuguggggguggacccggccggauucguacacgauagaggcccacuugaguga

SEQ ID NO: 2659 - RNA, 3180 nt, Artificial Sequence
  Cas9 variant
augggcaucagauucgccuuugaccuggggaccaacagcauuggaugggcuguguggaggacaggucccggcgucuucggggaggauacugcagccucccucgacggaucuggcguucuuauauuuaaggauggucggaauccuaaagacgggcagucacuggcgacgaugcgccgagugccacgucaaaguagaaagaggcgggaucgcuucguauugagaaggcgggacuuacuggcugcccuacgcaaagcaggacucuuuccgguggaugucgaagagggccgaagacuggccgcuaccgaccccuaccaccuuagggcaaaggcccuggaugaaaguuugacaccucaugagaugggccgggugaucuuccaccucaaccagcgucgcggguuuagauccaauaggaaagcugaccggcaggaucgagaaaagggaaagauugccgaggguucuaaacgccuggcggagacucuggcagccaccaacugcagaacacucggcgaguucuuauggucgaggcaucgggggaccccacgcacuagaucacccacaaggauccguauggagggagaaggcgcuaaggcccuguaugcauuuuacccuacccgggagaugguucgagcugaguucgaaagacuuuggacggcccagagcagguuugcgccagacuugcugacucccgagcgccacgaagagauugccgguauccuauuccggcaaagagaucucgcaccuccaaaaauaggguguugcaccuuugaaccgagugagaggcgccugccccgagcccuuccuuccguggaggcucggggaaucuaugaacgucuggcucauuugagaauuacaacuggcccagucucugacaggggccucacccgccccgagcgggacgugcuggccagcgcauuacuggccgggaagucccucacauucaaagcuguaagaaagacccuuaagauccugccucacgcguugguuaauuucgaagaggcaggagaaaaaggucuagauggcgcccugacggcuaagcuccugucaaaaccagaccacuacggggccgcauggcauggacuuaguuuugccgagaaggauacuuucgugggcaaacuguuggacgaggcugaugaagagaggcucauucgacgccuggucacagaaaaccgguuaagcgaggacgccgcaagaaggugugcgucuaucccccuggcugaugguuaugggcgucuaggccgcaccgccaauacugaaauacucgcagcccugguggaggagacagacgaaaccggaacgguggucaccuacgcugaggccguucggagagcaggcgaaaggacagggcgaaacuggcaccauuccgaugagcgggacggagugauucuugaucgcuugccguauuacggugagauccugcagagacacguagugccuggcucaggggaacccgaggaaaagaaugaggcugccagguggggacggcucgcgaacccaacuguccacauuggccugaaucagcuucgaaaagugguuaacagacugaucgccgcucauggucgcccugaccagaucguggucgaauuggcaagggagcucaagcugaaucgugagcaaaaggaacgguuagacagagagaacaggaaaaaucgcgaagagaacgaacgaagaaccgccauucuggcugagcacgggcagcgggauacagccgagaacaagauaaggcuacgccucuuugaagaacaggcacgugcgaaugccggcaucgcucugugccccuacacugguagagccauuggcaucgcagaacuuuucaccagcgagguggaaauagaccauauuuugccaguaagucugacacucgaugacucucuggcuaaccggguuuuauguaggcgcgaggccaaucgagagaaaagacggcagacccccuuucaagcauucggggccacuccugcuuggaacgauaucguggcgagggccgcaaagcugccaccgaauaaacgcuggagauuugaccccgcugcccuugaaagguucgagcgggaaggaggauuuuugggccgucagcucaacgagacgaaguaucugucccgccuagccaagaucuaccuggggaaaauuugcgauccugaccgagucuaugugacaccaggaacccucacuggccugcuuagagcuaggugggguuugaauagcauccugucggauucuaacuucaagaaucgguccgaccaccgccaucacgcagucgaugccgugguuauugggguguuaaccagaggcaugauacagaggaucgcgcacgacgcugcccgggcagaggaucaagaccucgaccgaguauuuagagauguccccgugccuuucgaagacuuucgcgaucauguuagggagcgggugucaacaauuaccgucgccgugaaaccagaacacggaaagggcggggcucugcaugaggacacuagcuacggacuuguacccgauacagacccgaacgcagcccugggcaauuuggugguucguaaaccuaucagaagccucacggcgggugaagucgauagggugcgcgaccgggcucugcgagccagacuaggggcacuggccgcuccauucagggaugaguccggacgcgugcgggacgccaagggccucgcacaggcucuggaggccuucggugcggaaaacggcaucagacgugucaggauucuuaagcccgaugccucuguugugaccauagcagaccggcgcacuggggugccuuaucgagcuguagcccccggagagaaucaccacgucgauaucgugcagaugagagacggcagcuggaggggguuugcugcaucaguuuucgaagugaaccggccaggauggcgcccugagugggaagucaaaaaguugggcgguaaacuggugaugagauuacauaagggggacaugguugagcucagugauaaagacggacagaggcgagugaagguaguccaacagauugagaucuccgccaaucgggugcgucugagcccccacaacgauggcgguaaacuucaggacagacaugccgaugcugacgauccauuucgcugggaccuggcgacaauuccgcuacucaaggauaggggcuguguggcaguccggguugacccuaucggggugguaacccugagacgcucuaacguguga

SEQ ID NO: 2660 - RNA, 3183 nt, Artificial Sequence
  Cas9 variant
auggccgugaaaagccugaacuacauccucggccuugaccuggggauugcuuccugcggaugggcagucguugagauggaugaacaggagaaucccuugagauuaauagacguggguguaaggaccuucgaagaggccgaaaacccuaaagauggaucuucacuggcggagacacggcgccuagcucgagcccaacguagacucaucaguaggcgggcaaaucgcaugaacaagcugagaaggcuucugaaacaggagaauguguugcaggccaacgacuaugaugaaaaggggcucauuaucggacugccaaaucaggcuugggagcugcgggcacaaggccucgaccgcaaauuagaaccgaaggagugggccgcuguccugauucaccuugugaagcaucgagguuacuugagccagagaaagaacgagucccagacugccgauaaggaacugggggcgcuacucucuggaaugaaucacaaccaucagcugcuucaaucgcagucaaaucaguauaggacgcccgcagagcuggccaucaaacaguuugcuacccaagacggccacauacggaaccagcguggcgccuacacacauacuuucaaucgcuuggaucuccagaacgaacugaaucaauuauuugacgcacagaccagacuggggaacccucacguuagcggaagucucaagacagcuaucaacgaucuucugaugaaucagaaagccgcguuguccggugacgccauucuagagaugcuggggagguguaccuucgaaccaucugaguauaaggcagcuaagaacacuuacagcgccgagcgguuuguguggcucggcaaacugacaaaucuucgaauccaggauaacggacuggaauccgcuuugucacgcgagcaaagagaacuccuguuaaaugagcccuauaacaagaccaaacugacguaccagcaggucaggaagcuacuccggcugccugaaacugccuucuuuaaaggccuucgcuacgguaaggacaaugcagagagugccaccuugauggagaugaaaagcuaucacgcuauuagaaagucucuggaaaacaagucccucaaaucagagugggaaaagcugaaaacacagccaaaacuucuggacuugaucgggacugcguucagcauauacaaaaccgaugacgagauugcaggaugccucaagaaucaacugcccgaaaacgugaucauugccuuacaggagcagcugaauuuuaguaacuucauggagcuaucucucaaggcucuggaaaaacuuuugccucugauggagcagggccucagguaugaugaagccuguacacaaaucuacggcaaucgucaugagaagaucgcagacaaaaccgagaaguuucugccaaacauuccggccgauaaauuacggaaucccguaguucugcgaacgcuuacucaggcuagaaaggugauaaacgccaucauuaggcgcuauggguccccugcacggguccacaucgaaacaggaagagagguggguaagagcuucucggacagggauaaauugaagaaacagcaggaagagaaccaagaacagcgccgacgggcgauagacgaguggaagcaguuuuucccaaaugcugcccaugagcccaaagcaguggauauucucaagcugcgucuauaccaacugcagcagggcaagugccucuauucugggcugccuaucgacgucagaaggcuuccagaaaaaggauacguugagaucgaucacgccuugcccuucucccgcaccugggacgacucauuuaacaauaagauucugguguuagcuagugaaaaccagaauaaaggcaaccaaacuccguacgaguaucuccggggugccgauaauagcgaauccuggagacuguucguagagaacgugcagaauugucaguuuucuccuaacaagaaacagaagaucauggcaaaacaacuugacgagaagggguuccuggaaaggaauuugaacgauacacgauacgucagccgcuuucucugccaguucauuucagaguaucugcaccuaaccggcaagggcaaaaagcggguguuugcuaguaauggccagauaacggcccugcucagagggagguggggacuguccaaaaaccgugaagagaaugaccgccaucacgcgguugaugccguggucguggcuuguagcaccguagcaaugcagcaaaagaucacacaguucguucgguaccagaaagguaacguguuuacuggcgaaagaauugacaaggagaccggggaggucaucucuauccauuuccccacaccaugggaacacuuuagggaggaagugaugauucgagucuucgaugacaacccucuucggacuuugcccgagaagcugccaaaucgccccgaggccuuacaugaauaugugaugccucucuuuguuucaagaaugccaaccaggaaaaugacaggacaaggccacaaggagaccauaaaaagugcuaagcggcuggaugaaaagaucagcgugcuucgaguaccgcugacucagcuaaagcucaacgaccuggagaauauggucaacagagaacgcgagcccgccuuguacgaggcacugaaggcgagguuagaacaguucaaaaaugauccugccaaggcuuucgccgagccauuuuucaaacagggugggcaacaggugaaggcaguucguguggaaauuguccagaaauccggcaugcuccugcggaagaucaacggaguggcugacaauggcucuaugguaagaguggauguuuuugagaagucggggaaauucuaucuuguccccauuuacgccuggcaaguggcagaaggaauccugccuaaccacgccgugguccauagcaaggacgaguccgacuggauauugauggaugagucauaccacuuuaaauucgcucucuauaagaaugaccugcuagaaguucagacgaaaaaggguugcaucaugggcuacuuugcgagucuggauagggccacaggggcaauuaccauccgcgagcaugaccgagauaaaaagaaguguaaagacggagaacacagaucuauuggcgugaagauggcuagcuccuucaaaaagcuccagguggaugagcuugguaaaaacauccacgaaacucggucaaggaagcgcccaaauauaggguga

SEQ ID NO: 2661 - RNA, 3186 nt, Artificial Sequence
  Cas9 variant
augcacacccugcccuacacacucggccuugacaucgggauugccagcgugggagcugcacuguuguccgaugagucuauauuagguaugcaugucagaacuuucucagccgcggaaacggacaaggagggcgauccucugaacaaaaucaggcgggaagcucgcagugcccgacguagaauuaggcggcgcgcacacagacuacucaggcugcggcgccuucugaagcgaaccggguugaucagcgacacaucccucgagguucugaaaacuucuaagaccccauggcagcugagaucggaaggacucgauagguuacugucaccgagcgagcuugccgcugcauuguaucauauugugaaacaccggggcuuucaaaguaaucguaaggccgagcugaagacagacgcuaaagccggucagaugcuauccgggguaucugcgaaccagcagcucaugcgcgauaagagcuacagaaccaucgcagaaauggugugcaaagacgaugccuucaaggaccauaaaaggaauaagggaggcuccuaucggaacacuuuugcucgaucagaucuggccgacgagcuuaagacacuguugaaaaagcaacgcgaauacgauaauccccucgcaaccccugagcuggaggaagcuguccacacguuacugauggccagaaggccaguguucaaagacgacgauauagagaagcucguuggcuuuuguacuuucgaacacggggagaaacgggcgcccaaggccgcauuuaguagcgaacgcuucaucuggcuuggaaaacugaacaauuugagacuaauuuauccuggugagcagaggucucugaccccagaggaacguucccagaucauuaaccuccccuuuacacaggcuucagugaaguucagccaaauccggaagaaacuggaccuuccugaguacguccgauuuaaucuggugagauauaagccaggcgaagagacuagcaaaucugaaaccgccacauucuuugaggcuaaggccuuccaugaguugaggaaaaccuaccgcgaauccgggauaagcgagcucugggaacgggaucagcacgacccgcagagacuggaucagauugcaacggccaucgcuguauacagggacgaugagcgcauucgaaacgaauuaucgccccauacuaucgagaaugagguuguggaagcgguccugaacugcgacuucacacaauuuaucaaucuaucucucaaggcacugaacaagauucuuccuuauauggagcagggacagcgguacgaugaagccuguaccuccgcuggcuaucaacaccacucaccacagcagaaugaggagaaaaguggucguauacccccuccagacaagaacgugaucagaaaccccguggucuacaggagcuugaaucaggcccgcaaacugauuaacgcaaucacuaagcgguauggggccccggcugccauacaucucgaaauggcaagagaucuguccaaaccuuucucugagaggaagaguauugaacgagagcaagaaaaguaccgcaaacagaagguucagcuucggaaugaguauaucgagcacuuuggaacagaacccaacggccugaauuugcucaaauucagacuguacaaggagcaggacgcgcaaugcgcuuacacccagaaagccuuagaccugucaaggcuaaacgaagcaggcuauguggagguagaucauauccucccauacagucguuccuaugacgauagccugcuuaauaagacguuggugcugaccgaagccaaccgcgacaaggggaaucggacaccuuuugaguucaugggaggugaugaccagucucagcacuggcaaaaauuugucagaugggugcagaugaaccccaagauuaggcaggcuaaacgaaaucgguaccuccgcaaggauuucucagagaaagccgcaagagaauuuagggaccggcaucugaacgauacucgauauaucggcagagaguuaaaggcuaugauugaaagucacguucaguggcacccagacagcaaauccaaggauuguugcgugguccugucugggcaacuuaccgccuugcuccgcggaagguggggcuucaauaaggaccgugcggccggugaucugcaucacgcuguggacgcagccguaguugcugccgcaacacgggggaugauacagagaauggcgaggcauucgaaauuucacgagcuaaagaacgugcgcacuagcuacgccgaccccgauaccggcgaagucgugaaucuggcugccgcacgagaccucgagaaacacuucccucugccaugggauaacuuuagaaacgacacacuugcuuauuugaauccguccgccaucucagcagaugagagugcccaggaaggacaucggggcgucagggugucucgcgcucccacccguagaaagcugggggcggcccaccaagagacuauucggagcaaaggaaaggacaacaucuuacucgaacagggucuguccgcaguuaagacgccucuuucaaaacugacauugaagaauaucgagaacauggugggcuacgaggauccaaggaaugcugcccucguaaaaguccugcgcgaacgacuagaggccuucgggggagacggcgcuaaggcauucgcccccaaccagccuccaguguacaaacccagcaagccggguaagcaggcgccugaaauuagaucuguuaaaauggcuuccaagaguaaaggggcccugcaugugcgggagggccucgcagauagcggaaggaugauacgcaucgacauuuaugaaaccaagaauggcuacgucggggugccaaucuauguaucugauaaagccagauccaagcugcccaaggcuuacccuaaaaagggagaggacagggcaaacuggcccgagguggauacuaaugacaacuuucuuuucucauuguauaguaccgacuggauugaagccaaaacaaagaaagagaccaucgcggguuacguuaagagcuaugauauauuugacggccggcuguuagucuacgcucacgauaauaaaaagguggugcguaagcucacucugucggcccuugcagaccugcaaaaacuacaugucuccauccucggggaucuguacaagggaggcacaccaaaauguucuccuuugcgcaagggucaggaacuguga

SEQ ID NO: 2662 - RNA, 3186 nt, Artificial Sequence
  Cas9 variant
augcugagacucggccuugacaucgggagcaccuccauuggaugguuccuguacaggauaacaaacgguaugaucgccgagauuaucgauugcggcgugcgguuguuuucugacgggcgcgaugcuaagacuggagucucaagugcaguugaacgacguaaugccagagcguuaaggcggcgcagagacagguaucugcggcgccgagcugcccuaaugagaaggcucgcagccgcuggccugaugcccgaggauccuagccaggcaaaaccacuugaacuguuggacccguaccggcuccgugccgaugcucuggaccgcagacuggagcucacggaauuagguagggcccuguuccaccuuaaccaacggcgaggguuuaaguccaaucgccagaccgauagaggaaacaaugagggcggcaaaauuaucgacgggucugcgagguuggaucaggcaaugauggccgugggagcucggacauauggugaguuccugcaucuacgcagaucgcaggccgaagaccucaggcguguacccucagugcggacucgacugacccuuagaagcgucgauggcgggaaggcagagacaggauacgacuuuuauccugacaggcgccaccuggaagaggaguucaacaaagugugggcugcccaagcggcccaucacccaguuuugaccgauagucuccggcaugaaguguuugagacuauauucuuucagagaccccugaaggcuccugcagucgguagguguuuauucuuuccagaaccccgccugccucgagcccacccacucacacagcggcgugugcuuuacgagaccguaaaugcucugagaaucaggacggaauccggcgccgcaguuccguuggggaaggagcagcgcgacaaagugauuaugcuacuggauggaaaggcccccgucaaagcuaucgcgucugcaaagcucagccugaaagccauugcuaagcaccuuaagcugcgggacggccaaacuuucaccuuggagaaaggcagagauuauaucgccugcgacccugugagggcaucccucucacauccagaucgauuugggccccgcuggagugugcuggaagccgagguccaggcugaaauaguuggacggauuagagacgaugacgauacaauggccuuaguggaguggcugaagcagguacacggucuagacgacgcacaugcgagggcuacugccgaugcaccucucccagaaggcuacgggcgucugggagagaccgccacacgcaaacuuuuggacugucugaaggcugaggugcucaccuacagcgaagccgucggcaaagcacuggaucagcaccacucugaccggagaacgggugagauccuugaaucccugcccuauuacggggagguguugcaagcucauguuauuccgggcacuggagaaccucaccaugaugacaucacaagguucggccgaaucaccaaccccacugugcacauugggcucaaucagcugcggcgcuuagucaacagaauaaucgccagguauggaaagccagcggagauugugguagagcuggcccgggaucuaaaacagucaacaggucaaaagaaggcugcaaucgcccucaaucugaaaaaccgaaaggcugccgaagcaagaagcgcgcuuuugaccgaguggggcguuccugacacgggggccaaucgcauguacgugaggcuguggcaggaacuccaugaggaucccaugaugcgucggugcccauauaccggaacaauaauuagucccucucuguuauucuccggcgcuaucgacaucgaucacauucugccuuacagcagaacucuugacgauucgaccgccaacaggacauuguguaugaaagaggcaaaucgccagaagcgaaacaaaucuccauccgaagcuagacgggacgguaugaggaucugggcccucgaggacgauaaccugcgccacauuccggaauuuaagcguuggagauucgcagaggacgccauggcucgguuugaaggggagagggauuucgaggcgcgcgcccuagucgacacucaguaucugucacgaauaaguaaggcauaccucgaaacccuguacgauggcgcugacggaaaaagccaugugugggucgugcccggcagacuuacagagauguugcggaggcacugggggcugaauggaaucuuaaccgauccucuccgcgacguuacuaaggagaaaaacagaauggaucauaggcaccacgccauugacgccgcugugguagcagccacggaucggggucugaucaaggcgauggcugaacaagcccguacagacgucgaucagggccgcgaagcacuugccuccucuaucaugccacccuggccuggguuucgagaggcuguggcagcccagguugacagaauuauagugagccauaggccagaccacggacggaucgaucugaccacucgcaugaaaggcagagaccagaccacaggucccuugcauagggauaccgcguaugggcucacuggccaaucagagaagggagucccgcuggugguaacacgggaaccuuucgacaaucuaacgccaaccaugauuggcaagauccgagaugagccccugaaagcugcccucgcagccgugacugcugggaagaaagacgaugccuuugcagaagcucuggcccacuucagagaccgcccuggacccuaccauggcauuaggcggguucgucuuaucgagccaauaagugucguggaaaucagagaugcguccgguagggccuauaagggguacaaaggaaacagcaaucacugcuuugagguguggcgcuugccuggcggugcaauuacagagcacaucgucucuaccuucgacgcucaucagcccggcccagaaccgcggccucaccccgccgcuaagcgacuguuaagacucuuuaagucagauaugguuaaacuggacgacaguaaguucgggccagugauugcaacagugguaauguuugauaggaacggaaaaaucagccuugucccccauacugccuccaaugcccgcaagcggugugagaaauauaaggaagaccuguaccuaagauucaccgcucguacgcucauagaggcgggcgcaaggcggauuaucguggaugagaccgggcacuuccgcgacccuggacgaaaaggcuga

SEQ ID NO: 2663 - RNA, 3189 nt, Artificial Sequence
  Cas9 variant
auggccgagaagcagcacagauggggccuggacaucgggaccaacagcauuggaugggcugugauagcacucaucgaagguaggcccgccggccuugucgcgacagggucccggauuuucucugauggacgcaauccuaaagacggcucaagucuggcuguugagcgacgugguccaagacaaaugaggcggcgcagagauagguacuugcggcgccgagacagauuuaugcaggccuuaaucaacguggggcugaugccgggagaugcagccgcuaggaaggcccuaguaacugaaaaucccuaugugcuccggcagcguggccuggaccaggcacuuacgcugccugaguucggccgcgcuuuguuucaucucaaccaaagaaggggguuccagagcaaucggaaaaccgaucgagccacagcgaaggaauccggaaaagucaagaacgcaauugccgcuuuucgcgccgguaugggcaaugcaagaacugugggggaggcucuggccaggcggcuggaggacggacgcccaguuagagcgaggauggugggccaggguaaggaugaacacuacgagcucuauaucgcccgugaauggauagcacaggaguucgacgcuuuaugggccucucaacagcgguuucaugcugagguccuggccgaugcagcccgagacagacuuagggcuaucuugcuguuccagcgcaaacuacuccccgugccuguagggaagugcuuucuggaaccaaaccagccccggguugcggcagcccuuccuucggcucaaagauucaggcugaugcaggaguugaaucaccuccgcgugaugacccuggccgauaaacgagaacggccauuaucauuucaggagcguaacgaccugcucgcacaacuugucgccagaccgaaguguggauucgacaugcugaggaaaauuguguuuggcgcuaauaaggaagccuaccgcuucacaaucgagagcgagcggagaaaggaauugaaaggcugcgauaccgcagcgaagcuagcuaaagugaacgcccuggggacuagguggcaggcacucagucuggacgagcaggaucgacuugucugucuguugcucgacggagaaaaugaugccguucuggcugacgccuuacgcgagcauuauggucugacagaugcacagauugacacccuacucggccuguccuucgaagaugggcacaugcggcuuggaagaucugcuuugcugagggugcucgacgcccuggagagcggccgugaugagcaaggucuuccccuguccuacgacaaggcgguaguggccgcuggguauccugcacacacggccgacuuggaaaacggcgagcgcgaugcucucccauacuacggagaacuguuauggcgguauacucaggacgcccccaccgcgaaaaaugaugcagagagaaaguuuggcaaaaucgccaacccuacaguccauauagggcugaaccagcuaaggaagcucgugaaugcucugauucagcgauacggaaagccagcccaaaucguuguggaacuugcacggaacuugaaagcuggucuggaggagaaggaacgcauuaaaaagcagcagacugccaaucucgagagaaacgaaaggauccggcagaaacugcaagacgcaggcguccccgauaaucgagagaacagauuacgcaugaggcuguucgaggaacuugggcagggaaauggcuuggguaccccgugcaucuauucagggcgucagauuagucuccagcggcuguuuagcaacgacgugcaaguagaucacauacuaccuuucucuaagacacuggacgauuccuuugccaauaagguucucgcucagcaugacgcgaacagauacaaaggcaauaggggacccuucgaggccuuuggcgcaaaccgcgauggguaugcuugggacgauauccgagccagagccgcugugcugccacggaauaagaggaaccgcuucgcagaaaccgccaugcaggacuggcuucacaaugagacggacuuuuuggcgcgucaacugacugauacagcuuacuuaucaagagucgcccggcaguaucucaccgcaauuuguagcaaagacgauguguacgucaguccuggaaggcugacugccaugcuucgcgcuaaguggggucugaaccgaguguuggacggcguuauggaagaacaggggagacccgcagugaaaaaccgggaugaccacaggcaucacgccaucgaugcgguagucauaggagcuacagaccgcgccaugcuccagcaaguggcaacccuggccgcuagagccagggagcaggaugcagaacggcuaauuggcgacaugccaacgcccuggccuaauuuccuggaggauguucgugcugccguggcgcgcugcgucgugucucauaagccagaccacgguccggaagggggccuccauaacgauaccgccuacggaaucguagcaggccccuuugaggacgggcgauauagagugaggcaccggguuucccuguucgaccuuaagccuggagauuugagcaauguccgcugugacgcuccacugcaggccgaauuagagcccaucuuugagcaggaugacgcuagagcaagggaaguggcccucacagcccuggcugagcgguaccgacaaagaaaaguguggcuugaggagcugaugucgguccuaccuauucgcccaaggggcgaagaugguaagacucuccccgacucugcgccguauaaagcauacaagggggauuccaacuauugcuacgagcuguucaucaaugagcggggacguugggacggcgaauugauuucaaccuucagagccaaccaggcugccuauaggcgcuuucggaaugauccugcacgauucagaagguacacagccgguggccgcccacuguuaaugcggcucuguauaaacgacuacaucgcuguugggacugcggccgagagaaccauuuuucguguggugaaaaugagugaaaauaagaucacacuggcagagcacuucgagggaggcacccuuaagcagagggaugcugacaaagacgaucccuuuaaguaucugacuaaaagcccuggggccuugcgggaccucggagcacgccgaaucuucguagaucugauuggcagaguccuagaccccgguauaaagggggauuga

SEQ ID NO: 2664 - RNA, 3189 nt, Artificial Sequence
  Cas9 variant
augaaccugaauuacauccucggacuugaccuggggauugccagcgugggaugggcugucguugagauagaugaacaggagaacccccaaagauugaucgacguggguguaaggaccuucgaucgggcagaaguguuaaagacaggcgagucccuggcccuagcgcgccgacucgcucguucuucaagaaggcuggucaaacggcgcgccgaaagaauuaagaaagcaaagaggcuucugaaagccgagaauuugcuccugagugcugacgagauccugccuaacgaagcauggcagcuccgggugaagggguuagaucagaagcuggagcgccaggaaugggccgcuguucuuuugcaucugcuaaaacaccgaggauaucucagccaaagaaagaaugaguccaaaucugagaacaaggaacugggcgcccuucugucggguguggcgauuaaucaccagaucuugcagucagcagaguacaggacuccagccgaaauagcugucaacaaauuucaggccgaggaagggcauauccggaaucaacguggagcauauacgcacaccuucagccgccucgaccuguuagcugagauggagcugcucuuucagagacaggccacacuuggcaacccgcauaccaguacuaagcuguuggaaaaucuaacagcgcugcucauguggcagaagcccgcccuggcaggcgaggcuauucuuaaaaugcuggggaagugcaccuucgaaccuacugaguacaaagccgcuaagaacuccuauucugccgaaagguuugugugguugacaaaacucaauaaccugcggaucuuagagcaaggagcagagcgagcccugaccgauaaugaacgcuucgcucuacucgaccagccauacgagaaggcgaaacugacguaugcacagguaagaacucuuuugggucugagcgaugaagccauuuuuaagggccucagguaccaaggggaggacaagaaagcuguugaaaccaagacaacucugauggaggugaaagccuaccaccagauccggaaggcacuugagggacuggauuugaaagccgaauggaacgagcucaagaacaaucccgcucuguuagacgaaauaggcaccgccuucucccuguauaagacagaugacgacauucaccgcuaccuagaugguaaacucucagagaguguccugaacgcacuuuuggagaaucugaacuuugacaaguucauccagcucagccugaaagcguuacagcaaauucugccucuuauguugcaggggcagagauaugaugaagcugugucugccaucuacggagaccauuauggcaagaaauccgaugagaucgacaggcuccugccaaauauucccaccgaugaaauacguaacccugugguccuacggacgcugacucaggcacgaaagguuaucaaugccgugguaagacucuacggcucaccagcuaggauucacaucgagacagggcgcgaagugggaaagagcuaucaagaccggaaaaagcuggagaaacagcaggaggaaaacagaaagcagagggagaaugccgucaaaaaguuuaaggaauacuucccgaacuuugugggugagcccaaaggcaaggauauacuuaaaaugcgcuuguacgaacugcaacaggcaaaguguuuauauagugggaaaucucucgagcuguaccgacuucuggagaagggauauguugaaguggaccaugcuuugccuuucucccggaccugggaugacagcuucaauaacaaaguccucgugcuggccaaugagaaccagaauaagggcaacgcgacuccauacgaauggcuagacgguaagaacaauucggagggguggcagcacuuuguagcccguguucaaacaucuggcuucuccuaugcuaaaaagcagagagugcugauucaggaacucgaugagaaaucauuuaucgagaggaaccugaaugacacccgcuacgucgcacgguuccuuugcaaccacaucgccgauaauauguugcugacgggaaagggcaaaagaaagguguuugcuaguaacgggcaaauuaccgccuuacucaggggauguuggggucugcagaagguccgagaaaauaacgaccgccaucacgcacuugaugcggugguuguggccugcagcacaaaauccaugcaggacaagaucacuaaauucguaaaguauaaagagggccggcuguuuaaggauaagaaagacggggucuacaagggagaaagaauuaauagggagaccggcgagauaaucucucuacauuuccccacaccuuggaaauuuuucaaggaaaacguggagauucguaucuuuagcgaaaauccaaaacucgagcuggaaaaccgcuugcccgauuacccgcaguauaaucacgaguucguucaaccucuguuugugucacggaugcccacuagaaagaugaccggucaggggcauauggagacagucaagagugcuaaaagguuagacaagggccucuccgugcugaaaguaccacuuacccagcugaaguugagcgaucucgaacgaauggugaaccgggagcgcgaaauggcccuguacgaggcacuaaaagaaugucuggagcaguucggaaaugacccugcuaaggccuucgcagagcccuuuuauaaaaagggcggggcccuuguuaaggcugucagaguggaacaaacucagaaaucuggagugcucgucaggaacgguaacggcguugcggauaaugccacggggucaaucgugcggguggacguauucacaaagggaggcaaauacuuucuggucccaauuuauaccuggcaaguggcaaaggguauauugcccaacaaagcuguuauccaggggaaggacgagagugaaugggaggaaauggaugagaaugccguguuccaguuuagcaugcacaagaacgaccugauuaaagucaagacuaaaaagggcgagaucuucggauacuuuaauggcuuagaucgagccaccggguccauugaaaucgaggaacacgaccucgagaaaucuaagggaaagaacggcucgcauagaggucugggggugaaaacagcuuucuuucuugagaaguaucagguugaugaacugggcaaaaauauacgcccuugcaggccaaccaagcgucagcacgugcgguga

SEQ ID NO: 2665 - RNA, 3192 nt, Artificial Sequence
  Cas9 variant
auggagaaccacaucaauuacagacugggccucgacauugggauagccagcgugggaugguccgucaucaaccuugauaagaaaaggauugaagaccuggguguucggaucuucaaugcugcagagcaucccaaggauggcaguucauuggccuuaccucgccgaauugcgcgugggagaaggcggcugcuacgcagaaaggcuuauagggugaagcggguacgcaaacucaucguggacuacaacauacugaccaaggaucagcuuaaugaccuguuuaagcaaaaaugccagaacagugucugggaaauccgagugaaggccuuggauaauaaaguuacaaacgaggaaugggcaagacuccugauuaaucuguguaagaggcggggauucaaaagcaaccguaagaaugaggccgacgauaaggagacuaaaaaggugaucaacuccauuaaaucuaauaucaagggcaugaaagaaucggguucacgcacgauaggggaguauauuuacacccagacacucagcaguggagacaucuccaagucuuuuagaaacaaagauggccaguauaauaacugcgucagcaggaagaugauugaagaggagaucaagaucuuauucaaaaagcaacgggaacugggcugugaguuugcuuccgaagagauugaagagaaauaccuugcaauauucaacucacagcgaccauuuaguaaguucgaggacuuggagaaaauggugggguuuugcacuuucgaaaaggccagcaaggaacgcagagcuccgaaauguucuaucuccgccgaggaauuuguacuguaugauaauaugaacaagcuaucaauucucaauaaaggagacaccaggaagcugacaaacgaggagcggaaaaucauaguugaaaaugcguucaagaacaaggagauuaaauacagcaaacuucgcaaaauccugaauuugaguaacgacgaaagauuuucuacccucuccuacagcaauaagacugagcugucgaaaacagaaaacucuaaguucguggcauuaaaggguuaucacgagaucaaauccgccauugagaagucauucggcaaagauaccuggaauagggucaagaacaaucguacgaugcugaacgacaucgcuuacgugcucaguauugccaaaacugaugaagacauaaucaagcagcuuagccugcggaauauuccccgagagaucaucgaugcaguguuggggcuauccuuuucuaaauucagcaaccugucaauuaaggcuauagaaaagauccucccuuaucugaaagacggacagcaauacaacgaggccugcaagagugcgggcuaugauuuuaaagccaccuacaauggugagaaguccuauaaacuuccacugauugacaucgaugaaauugucaaccccguugugaauagagcauugagccagacaaggaagguaaucaacgcugugauagaccgcuacgggucuccuaucggaauuaauaucgagcucgcccgggaucuggcuaagaacuucaaagacagaucaaagauuaaaaaggaacaggaggaaaauagggccaacaaagagaagaucaagaaugaguuaaaaaugcugaugaacaaggaaccaacuucuagcgagauacuaaaauaccgccucuggaaggaacagcgagaggaaugugcauauucccaagagcggauuuacaucgaggaccuguuuaaagucggccaguaugaaauugaucauaucauacccuucucucguucguuugacgauagccuuaauaacaagguguugguuaaggccgcugagaaucagagaaaagcgaacaggaucccuuacgaauauuucggcuccgacgaggaucgcugguaccgguuugaagugugggucgagcaaucaagucugucuuucaagaaaaagaauaaccuccugaaaaagagauuuagcagggaggacuccauugaguucaaagaucgaaaccuuguggacacccaguauaucucacgcuacauuagcaauuuuaucaagucucggcugauauucaaggaauccgauaguaaacagaagguaauuacaaucaacgggagagcaaccagcuacuugagggccaaauggggacuccugaagguucgugaaaauggugacaaacaccaugcuuuagaugccacggugaucgcagucgccacucagggcauggugcaagagauuucuaaguauuccaaggcucacgagcugaaauacauccgccagggggacgaguucauugauauagaaacaggagaaaucgucaaggugaaagaccacaagcaucuaucaaaagaccggcucccagagccguggcugggcuuuaguagcgaacuuagauugaggcugucggagaaccccauugaggaacucaagaaguccccuaucucuaccuaugaugaggaguucauucgaaaaacuguucggccaaucuuugugagccgcguacccuacagaaaggucacagguaggcuguucgaagaaaccguguauucaccuaaagccuuuauagacgagggguucaucgcaaagaaaaaguuacaggaucugacgcuuaaggacuuugagaauauuuacaacuauaauagugauaaaaaguuguacgacgcgcuccgggaacgacuggaggaauacggcggaaacgcuaaaaaggccuucgcagaggaauuuagaaaaccaaccaagacaggcaagcuagggcccaucguuaaauccauuaaggugaaaacuaagaucccguucaaagauggaauagaccugaaugguggcaaggucaaaaaggaugggcucgugcgcauugacaucuaugagaaggagggaaaauacuauguagugccuguuuacaggcuggauauccagcaaggcaacauucccaagaaagccgcugucgccaauaaggaagagaaagacuggauacuuauggaugaaucuuauaacuuuaaguucagcuuguacaagaaugaccugaucuauauuaaauacgacuccaagggugaguacuuuggguauuacgauggcuucgaccgucacaccggagcaaucacauuagagcggcaugauaacucagaaagauauaggggcauugggaucaaaacuggagugaaggagauauucaaauacaauguggacguccucggucgcuauuacaagguugcuaaguga

SEQ ID NO: 2666 - RNA, 3192 nt, Artificial Sequence
  Cas9 variant
auggagaaguuccacuacgugcugggccucgaccuugggaucgccagcgucggaugggcugcaauugaaauagauaaagagaccgaaacauccaucggucuguuggacugcggcguuagaacuuuugagagggccgaagugcccaagacgggggauucuuuagcgaaagcucggcgcgaggcccgaucaacccguagacugauuaggcggcgcagucauagacuacucaggcugaagcggcuucugaaacgcgagaucuuccgacagccugaaacauuuaaggacuugccaauuaacgcauggcagcucagaguaaagggacuggauagcaggcugaaugaguaugaaugggccgcugugcucuuacaccuggucaaacaucggggcuaccuuucccagcguaagucugagaugucggagacugacucaaaaagcgaaaugggucgcuugcuggcagggguggccgagaaccaccagcuacuccagcaagaacaguauagaaccccggcugagcuggcccuuaagaaauucguuaagcauuuuaggaauaagggaggcgauuacgcgcacacauucaaccggcuggacuugcaggcagaacuccaccuguuauuucagaaacaacgagagcugggcaaucccuucaccaguccugagcucgaacgccagguggaugaccuucugaugacucagagauccgccuugcagggggaugcuauccuaaagaugcugggacauugugguuuugagccagaacaauucaaagccgcaaagaacacauuuucugcugagagguucauauggcucaccaaacugaauaaccuucggauccaggaccagggcaaggaacgcgcccugacggcggaugagagaacuaaauugcucgacgagcccuauaagaagucaaaacugaccuacgcccaagucaggaaguuacugucccuaccucagacagcaauuuuuaaagggcuccguuaugaccuggaacacgauaagaaagcugagaauagcacucuuauggaaaugaagaguuaccauaacauccggcagaccuuggagaagucuggacugaaaacagaauggcagucuauugccacccaaccagagauccucgacgcuauaggcacggccuucuccauuuacaagacugaugaggacaucucacacgaacugaaaacaugccgacuucccgagaaugugcugaacgaauugcucaagaauauuaacuucgaugguuuuauccagcugagcuuaaccgcacugagaaaaauccuaccucucauggagcagggguauagguacgacgaggccuguacucagauuuauggaaaucaccauaguggcucucugcaacaggaauccaagcaguuccuuccacacauaccgaucgaugacguacgcaaccccguuguguuucggacauugacccaggcuagaaaggucgugaacgcgauuaucaggcgcuacggcagcccugcacgagugcauauagagauggcccgggaacuggggaaaucgaagucugaucgugacagaauugagaaacaacagcagaagaauaaaaaggaaagggagaacgcugucgccaaguucaaagaggauuuuccagacuucguuggagaaccccgcgguaaggacauccucaaaaugcggcuguaugagcagcaacacggcaagugcuuauacuccgggcaugauaucgacauuaauagacugaacgaaaaaggauauguggagaucgaucacgcacuuccuuuuucaaggacgugggacgauagucagaauaacaagguauuggugcucggcagcgaaaaucagaacaaacgaaaucaaaccccagacgaguaccuggauggugccaacaauucccagcgcuggcuagaguuccaggcucggguccagacaugucacuuuucuuacgggaagaagcaaaggauucagcuggccaaacucgacgaugaaacugagaagggcuuccuggaaagaaaccuuaaugacacccguuauauagcacgcuuuaugugccaguucgugcaggagaacuuguaccugacaggaaaaggcaagcgguuaguuuuugcgagcaaugggggaaugacugcuacccucagaaaccuguggggucuuaggaaagugcgagaagauaacgaccggcaucacgcccuggaugcaaucgucguggccuguucaacagcuaguaugcaacagaagauuaccaaggccuuccagcgccaugaguccaucgaguauguagacacugaaacgggcgagguuaaauucagaaucccccagccgugggacuuuuucaggcaagaagugaugauucgggucuuuagcgaucagccuugcgaggacuugguggagaagcucucugcacgacccgaagcucugcacgauaaugucacaccacuauucgugucaagagccccuaaccgcaaaaugagugggcagggacaccuggagaccauaaagagcgcgaaaaggcucuccgaagagaauagcaugguuaagaagccccugacuacccuuaaauugaaggacaucccagaaauugugggcuaccccucgcgugagccucaacuguaugccgcuuuaaaaacacggcucgagacccaugaugacgauccaaucaaggcauuugccaaaccguucuacaagcccaacaagaauggugaacugggggcucuuguaagaagcgucagggugaaaggcguucagaacacuggagugaugguccacgacggcaaggggauugccgauaaugcaacaauggugcgcguagacguguauacgaaagcgggaaagaacuaccugguuccugucuacguguggcaaguggcccaggguauccuaccaaaucgagcugucaccuccggcaaaucagaggccgauugggaccucauagaugaaaguuuugaguucaaguuuucucugagcagaggggacuugguugaaaugaucuccaacaaaggacggauuuucggcuauuacaauggucuggacagggcaaacgggucaaucggcauucgcgagcaugauuuagaaaagagcaagggaaaagacggcgugcaccguguggggguaaagacugcuacagccuuuaauaaauaucaugucgauccccucggaaaggagauccacagauguucuuccgagccucggccaacccugaaaauaaagaguaagaaauga

SEQ ID NO: 2667 - RNA, 3192 nt, Artificial Sequence
  Cas9 variant
auggagaaggacuacauccugggccucgauauugggauaggaagcguggguuauggccuuaucgacuacgauaccaaauccauuaucgacgccggggucagacuguuccccgaagcuaacgcagauaauaacuugggaaggcgggccaagcgcggcgcgcgacguuuaaaaagaaggcggauucaccgccuggagagaguuaagucucuacucucagaauauaaaaucauaaguggucuggcuccuacaaauaaccagccauacaauaucagggugaaggggcuuacugagcaacugacgaaggacgaauuggccguagcacuccugcauauugccaaacggcgcggaauccacaacguggaugucgcugcagacaaggaggagaccgccagcgauucccugucuacaaaagaccagauuaauaagaacgcuaaauuucucgaaucgcgauaugugugcgaguuacagaaggaaagacuggagaaugagggccauguuaggggcguggaaaaccgguuccuuacuaaggauaucguccgugaggccaaaaagauaauugacacccagaugcaauacuauccggaaaucgaugagacauuuaaagaaaaguacauuucauugguggagacccgcagagaguacuaugaagggcccggaaaagguagcccuuacggcugggacgcggacguaaagaaaugguaucagcugaugauggggcacuguacuuacuucccaguugaguuuaggagugugaaguaugcauacacagccgaucuauauaaugcucucaacgaccugaauaaccuuaccaucgcccgggaugacaaucccaagcuggaauaccaugagaaauaccacaucauugaaaacgucuucaagcagaaacgaaacccuacguugaagcagauagcaaaagagaucggagugaaugauauuaacaucuccggcuaucgcgugacuaagucugguaagccacaauuuaccagcuucaaacucuuucacgaccugaagaaagucguuaaggaucaugcuauauuagacgauauugaccugcucaaucagaucgccgagauccuuacaauuuaccaggauaaagacuccaucguggcggaacuggggcaguuggaguaucuaaugucagaagccgacaagcaaaguauuagcgagcugacuggauacaccggcacacacucucucucccugaagugcaugaacaugauaaucgaugaacuuuggcauucaagcaugaaucagauggagguauucaccuaucugaacaugagacccaaaaaguacgaguugaaaggcuaucagaggauuccuacggacaugaucgaugacgcaauccucaguccaguggucaagcggucuuuuaaacaagcuauuggggugguuaaugccauaaucaagaaguacggacugccgaaagauauuaucauugaauuagcucgcgaguccaacagcgccgaaaagucgagauaccugagggcaauccagaaaaagaaugagaaaacucgugagcggauagaagccaucauuaaggaguaugguaacgaaaaugcuaaaggccuagugcagaagaucaagcuccacgacgcgcaggaggggaaaugucuguacucucuuaaggauauucccuuggaagaccugcuccgaaacccuaauaacuaugauaucgaccacauaauuccaagauccgucucauucgaugacaguaugcauaauaaagugcugguaaggcgcgagcaaaacgcaaagaaaaacaaucagacacccuaccaguaucuuaccagcggauacgccgauaucaaguauuccguuuuuaagcagcacgugcugaacuuggcugagaauaaagaccggaugacuaagaaaaagagagaauaccuccuggaggaaaggaacauuaauaaauacgacguccaaaaggaguucaucaaccgcaauuuaguggauacacgauauaccacgcgggaacugaccacacuacucaagacuuacuucaccauaaacaaucuggacgucaaagugaagacaaucaacggcucuuuuacugauuuccuucguaaaagaugggguuuuaagaaaaauagggacgagggguauaagcaucacgccgaggaugcauugauuaucgccaacgcugacuaccuguucaaggaacauaaacuccugaaggagauuaaagauguuagcgacuuagccggcgaugaacgcaauucaaacgugaaggacgaggaucaguaugaagagguauuuggaggcuacuucaaaaucgaggacauaaagaaauauaagauuaagaaauuuagucaccgggucgauaagaaaccuaauagacagcugaucaacgacaccaucuacuccacaagggugaaggacgauaaacgauaccuuauuaacaccuugaagaaucucuaugacaagagcaacggggaucugaaagaacgcaugcagaaggacccagagucucuacugauguaccaccaugauccccaaacuuucgaaaaacucaagaucguuaugucacaguaugagaaugagaaaaacccgcuggcaaaguacuuugaagagacgggacaguaucuuacaaaguacgcgaaacacgacaaugguccugcuauucauaagauaaaauauuacggcaacaaguugguggaacaccuggauaucaccaaaaauuaccacaacccccagaauaaggucgugcaauuaagucaaaagagcuuccgguuugacguauaucagacugauaaaggguacaaguucauuuccaucgccuaucucacccugaaaaacgagaagaauuacuaugcaauuucucaagaaaaauacgaccagcuuaagucggagaagaaaaucagcaacaaugccguguuuauaggauccuucuauacaucagauaucauugagaucaacaaugaaaaguucagaguuauuggcgucaacagugacaaaaacaaucugaucgagguggacaggauagauauucgucagaaggaauuuaucgaguuggaagaggagaaacaggugaacuacaugaacucugacagcuaccucaagaauaaucgcaucaaagucaccauuggucggaagacuacaaacauagaaaaguuccauacggauauccuggggaauauguauaaauccaagagaccaaaagcuccucagcuaguuuuuaagaaaggcuga

SEQ ID NO: 2668 - RNA, 3195 nt, Artificial Sequence
  Cas9 variant
augagcgagugcgugaccagaaggauccugggcauugaccucgggauagccuccuguggauggggugucaucgaaguuggcgaggcuucugggucaauuaucgcaaguggagugcggugcuucgaugcgccccuuauugacaagacaggcgaaccuaaaagcgccacucgccgaacggcucguggucagagaaggaucauacggcgcagaaggcaacggaugaacgccguacgccgacuguuggcagaguuugggguguuaaccggaagauccccagaugcccugcaccaggcucuacucaggcugucucagucggucgcaggcucacaggugacaccguggacucuucgggccgcugcccaugaacguaagcugaccaaugacgaguuggcgguugugcucggccacaucgcacgccauagaggguucaggagcaacaguaaaaaugauggaggugccaacgcugccgacgagacauccaagaugaaaaaggcaauggaaaccacucgggagggccuggcucgauaccacucuuuuggggccaugauugcgagcgaucccaaguucgccgaccgcaaaagaaauagggauaaggacuauucccauacagcaaaacggucagaucuggaagacgagguccgcaccaucuuuagaagucaaacgagguucggaagccucguggcuucugagaaguuaucccaggccuuugcugaugccgcauucuuucagcguccucugcaggacucagaagacaugguaggcagcuguccauucgagcccggucaaaaacggacugccagacgagcuccuaguuuugaacuuuucagguuuuugucucgccuggcgaaccuaaagcucaccguugggcgggcaccagagagaaggcugacacccgaugaaauugcccuugcugccaagggauucggcgagacuaaaaaguccaucaccuucaaaagccugcgcgaggcauuggaccucgauccuaaugcccgauuuucgggcguggcuaaggaaaaagagucuacacuggacgucgccgcacggaccgggggagcggcuuacgguacgaagacuuuaaaagaugcccugggcgacgcaccauggcguucccucucaagaaugccggaaaaacuugauaggauagccgagauucugaguuuccgcgaagacaugaaggcuauccggaacggguuggaggaggugggacuagauggccugguggucgacgcccucaugcaggcaacagcuaauggugauuuuaaagacuucaccagagccgcgcacauuagcgcccuggcugcaaggaacaucauccccgggcuucgagaaggccugguuuauuccgacgccugcacucgcgugggauacgaucacgcugcccggccugcaguaccauugucucagauuggcagccccgugacaagaaaggcgcucucagaggcccugaaacaggucagggcuguggcccgugaauaugggccuauagacuacuuucauaucgaguuagcacgcaguauuggaaaguccgcugaggaacggaaaaagcugaccgaugguaucgaggccagaaauguugaaaaggagaaaaggcgaaaggaagcagccgagcaccuaggccgggcuccaagcgacgaugagcuccugcgcuaugaacuugcgaaagagcaaaacuucaaguguauauacucuggggaccccauugauccggccggaaucucagcaaaugacacgagauaccagguggaucauaucuugccuuggaguagguuuggcgacgauagcuaugucaacaaaacccugugcacagcucgguccaaucagaacaagcgagguagaacucccuucgaaugguuugacgccgauaagaccgaggccgaauggauggaguacucugcucgcguggaggaccucaaagaaguaaaggggaggaaaaagcguaacuauucgauuaaagacgcagccagcguugaggauaaguucaaggcgcggaaucugacagacacucaaugggcuaccagacuucuggccgaugaauugaaaaggauguuuccaccucgcgagugugaacgaguggucacagugagagcagacggcggaaacgauggccucuccaucgucgaggagcggaggguguucacccgccccggggccauuacuucaaagcugcguagagcuuggggauuagaaggucugaaaaagcaggacggcaaacggguugaggaugacaggcaccacgcaguggaugcccuaguacucgcggcuacgacagaaagucugcuuaaucgcuugaccgucgaggugcagcagcgagaaagagaggggcggcaagacgauauauuucauugcucucagccauggcccggauucaggguugacgugcagcgcacugucuacggcagcgagaccaugccugguaucuucguguccagagccgaaaggcggcgugcacgcgggaaggcccacgaugcuacaguaaaacagauucgagacaucgacggcgagagaaucguguuugaaaggaagccaauugagaagcugaccgauaaagaccucgagcggauaccgguucccgaaccuuauggaaaggccgcagauccaaagaagcugcgcgacgaguuagucgaaaaccugagagcuuggaucgccgcgggcaaacccaaggauaagccuccaaggucacccaaaggggacauuauccggaaggugcgaauugagacuaaagauaagguggccgucgaaaucaauggaggcacaguugacagaggugauauggcacgcguggacguguucaggaaaaagaacaagaaagggguaugggaguuuuacgucauaccgaucuauccucaucaaauuguggcuagcgcccuuccacccaaucgggcuguuaucgcauacaaggccgagucugaauggacggccauugauggauguuucgaguuugcuugguccuugaacccuaugaguuaccucgaacuggugaaaagcaauggcgagcuaaucgaagguuauuuccguucuauggacagaaccacuggcgcgauaaaccugucccccaugucaacaaauagugagaccauuaggagcaucggggucaagacacucucguccuuucgcaaauucacuguggaccggcugggacgaaaguuugagauuccaagagaaguuaggaccuggcgcggcgaggcaugcacguga

SEQ ID NO: 2669 - RNA, 3195 nt, Artificial Sequence
  Cas9 variant
augaagagaaccagccugagggccuaccggcucggcguggaccuuggggcuaacucccugggaugguucgucguuugguuggaugaccacggucagcccgagggcuuagggccuggaggcgugcgcaucuuuccagauggucgaaauccgcaaucuaaacagucaaacgcagccgggcguagacuggcgaggagugcucggcgcagaagggaccgguaucuacagcgccgaggaaagcucaugggccugcuuguaaaacauggccugaugcccgccgaugaaccugcaagaaagagguuggagugccucgacccauacgggcugcgggccaaagcucuggaugaagugcuccccuuacaccaugucggacgugcacuguuccaccuuaaucagcgcagagguuuguuugccaacagggcuauugagcaaggcgacaaggaugccagcgcgauaaaggcagccgcugggcggcugcagacauccaugcaggccuguggagcacgaacucuaggcgaguuccucaaucgcagacaucagcugagggcuacggugcgggcccgcucuccuguugguggggacgugcaagcgagauaugaguuuuacccaaccagggccauggucgaugcagaguucgaagcuaucugggccgcucaggcaccccaccacccuacaaugacugccgaggcccaugacaccauucgugaagcuaucuuuucgcagcgggcgaugaaacgaccaucaauuggaaagugcagccuugauccggcaacaagucaggacgacguggauggcuucagaugugccuggucccacccccuggcucaaagguuucgcaucuggcaggacguacggaacuuggccguuguggagaccggcccuacuucuagcagacucgggaaagaggaucaggacaaggucgcaagggcccuguuacaaacagaucagcuguccuucgacgaaauacgcggacuccuuggucugccaucagaugcucgauuuaauuuggagagugaccggcgugaucaucuaaaaggcgacgccaccggggcaauccugagcgcgagaaggcacuucggacccgcuuggcacgaucgcucucucgaccggcagauugacaucguggcccugcuugaauccgcacuggaugaggccgcuauuaucgccucauugggcacgacucauagccucgacgaagcagcugcccagagagcgcugagugccuuacugccugaugguuauugcaggcuagggcuccgagcuauaaagcgcgugcugccacuuauggaggcaggccggaccuacgccgaggcugccucugcagcgggauaugaccacgccuugcugcccggcgggaagcucuccccgacaggauaccugccuuacuauggucaauggcuucagaacgaugucguuggcagcgacgaugaaagagacacuaaugagaggcguugggggcgccugcccaacccaaccgugcauauuggaaucggccaguugcggagaguagugaaugaacucauuagguggcacgguccucccgcugagaucacagucgaacugacccgagauuuaaaacugucgccacggcgccuagccgagcucgagagagaacaggcagagaaccaaaggaagaaugacaaacggacgucucugcuucgaaaguuggggcugcccgcuuccacucauaaccuccugaaauuaagacugugggaugaacagggcgacguggccucagaguguccuuacacaggagaagcaaucggccuugagcgcuugguuagugaugacguggacauugaucaccucauaccauuuagcaucuccugggacgauucugccgcuaauaaggucgugugcaugagguaugcgaaccgugagaaagggaaccggaccccguucgaagccuucggacacagacaggguaggcccuacgacugggcagauauugcugagcgcgccgcccgacugccuagaggcaagcgguggagguuugggccaggagcucgcgcacaguucgaagaacuaggcgacuuucaagcccgucugcucaaugagacuagcuggcuggcgagaguagcuaagcaguaucuugccgcaguuacacauccccaccggauccauguguugccugguaggcugaccgccuuacuccgcgcuacgugggaacugaacgaucuucugccagggucagacgaucgagcagccaaaaguagaaaggaccaccggcaccaugcgauagaugcuuuggucgccgcacucaccgaccaggcccugcuaaggcgcauggcuaaugcccacgaugacacaagaaggaaaauugaggugcugcuccccuggccgacuuuccggaucgaccuggaaacccgucuuaaggcaauguuggucucccauaaaccugaucacggccugcaggcucgcuuacaugaggacacagccuacggaacuguggaacacccagagaccgaggauggcgcgaaccucguuuaucgaaagacauuuguggacaucagcgaaaaggagauugauagaaucagggaccggcgccugagagaucuuguaagggcccacgucgcaggggaacggcaacagggaaaaacccugaaggcugccgugcuaucuuucgcucagcgaagagacauugcaggccaucccaaugguauacgccacguuaggcucacuaaaucaaucaagccugauuaccuggugcccauucgggacaaagccgggcguaucuacaagaguuauaacgccggagagaaugcuuuugucgauaucuugcaagcggaaagcggcagauggauugcaagggccacgacaguguuccaggcuaaccaggccaaugagucccaugacgcaccagccgcucagccuauaaugcgcguauuuaagggugacaugcugcggaucgaucacgcgggcgccgagaaauucgugaagauuguucgauuaucucccucgaacaaucuccuguaccuugucgaacaucaccaagcagggguguuucagaccagacacgacgauccagaggacagcuucagguggcuguuugcuuccuucgauaaauugcgcgaauggaacgccgagcucgugcggaucgacacucugggacagccguggagacguaagaggggccuagaaaccgggucagaggaugcaacacggauuggauggacccgcccuaaaaaguggcccuga

SEQ ID NO: 2670 - RNA, 3198 nt, Artificial Sequence
  Cas9 variant
augaacaaggacaucaauuacgcccugggccucgauauugggauaaccagcgugggaugggcugucaucaaccuugaccugaauagaauugaggauuuggguguuaggaucuucaacgcagccgaaaauuuaaaagacggcuccucucuggcgcuaccccggcgccucgcucgagggcguagaaggcugcuucggcgcaaggccuauagaguggagaggguacggaaacugauuuugaagaacaauauccucacaaaagaagaacuggaaggacuguuuaagaacaaggaggugauagaugucugggaggcacgcgugaaaggccucgacuacaaguuaucacgagaagagugggccaaaauccugauuaauuucugcaagagaagggguuuuaaaaguaaccggaagaaugaagcuaaggauaaagaggcagggcagauccuuagcuccauuucuuauaacaucgagaagaugaaagaaacuaauucgcguacgauaggagaguacauuuauaacgaaguuaaaaauucagaggacagcuacgccccuuugcgcaacaaauucggcgaauauaagaugugugugaguagagaugucaucagggaggagauucacacccuguuugaaaaacaacgggagcuaggcaacaauuucgcuuccgacgaaaucgaggauaaguacuuugaaaucuucaacucucagcgaccauuuagcaauuucgaggaccucgagaagcuggugggguuuugcacauucgaacgcaaaaagcauaaaagagccccgaagcacuguauuuccucagaggaauuuacucuuuacgagggaauaaacaaacugaguaucauuaaggauggugaaaagaggaaauugagcgaggaggaacggacccucguaguuaaugaggcguucaacaagaaagaaaucaaguauacaacccugcgcaaauuacugggccucucugaggaggaacuuuucuccacucugacauacucaauagacaaggacauuagcaagaccgagaauacgaaauuugugaguuugaagggguaucaugaaaucaaaagagcaaucgagaagggagucucuaaaaaggccuggcaggauauugaaaacaauaggaaccuacugaaugacaucgcuuacgugcucacucugggcaagaccgaugacgagauugagaaacagcuucgucugcggaacgugcccgaagaguuguucgaaucccuccuggauaugagcuuuaauaaguucaacaauuuaucgauauaugcccuggagaaaauccuaccuuuuaugaaggaagguuaccaauauaacgaggcaugcgagaaagcuggguacaacuucaaggccauuuacgaaggaguccgaacaaagaagcucccaguuaucgagaucgacgaaauugugaaucccguagugaacagagcgcuggcccagacuaggaaggucauaaauucugugaucgauaaauauggcuccccuguucgcauuaacaucgagcuugcacgggacuuggcuaagaauuuuaaagauagaaagcugauugaaaaagagcagaaggagaacagggccaaucucgacaagauccgcgaaaaccugcgagagcuuauggauaaagaaccaaccguggucgaggugcugaaguaccgguugugggagcagcaacguggcgaaugugcuuauacacagucacagauaccccucgagagacuguucaguccuggguacugcgaaaucgaccacauuaucccauuuagcagguccuucgacgauucuuuaagcaauaaaauucugguacuaggaucagagaaccagcgcaaggguaaucggaccccguaugaauacuuuggcgaggacagugagagauggaacuccuucgaaaucuggguuaaagggagcuaucucaauuacaagaagaaagccaaccugcuuaagaaaaaguuuucugaggaagaacaaagggauuggaaagcacgaaauuugcaggacacgaaguacauaugucgcuauauuucaaacuucgugaacaaucggcuggaguucaaggagagugagaacaaacagaaggucaucacugugaauggcagagccacagcuuaccucaggagccguuggggacugaacaaaguccgcgaagauggugacaagcaucacgcguuagaugcagccgugguuggggugaccacucaaggcaugguacagaaaauuuccaaguauucuaaagcucacgagcuguacacaguccggaagaaugacgaauuuguggauguugagaccggagaaugcguggacgucgaugaguauaaggagaucagaaaagacauacuucccaggccuuggcgaggcuucucggaagaguugaagcuccggcugagcgauaacccacuagaggagcugaaaaagucccccaucgagacguacaaugaagaguuuauuaaagaaaacgugaagccuaucuucguaucacgcgugccauuuagaaagauuagugggaaacucuucaaggagaccaucuauucugaaagggccuuuaaagacggauacuucguuagcaagaaaucccuggucgaccuuaagcggggugauuuggacaauuuuuacaacuaugagugugauaagaaacuguacgacgcaauaucagagcgaaugaaggaguucaauuauaacggcaaaaaggccuuugaaagccccuucagaaaaccgacaaagucugggaaggaaggaccuguggugcgcuccgucaaaauuaagagugcuguucccuuuaaagauggcaucccaaugaaugaggguuuaguggccaaggaagggauggugaggaucgacauuuacgagaaagagggcaaguauuucguagucccuguguaccguuaucagcucgcaaagggaaucguucccaaacgggcggcuauugccaagaaagaugaacugaaguggccaauaauggaccagacuuacaacuucaaauuuagcaucuacaagaaugaucuuauugaggugaaauaugacaagaagggcgucuacuucggguauuacgauggauuugacagaaacucugcaucccugaccaucgaaaaacaugauaacucagagagguaucgcaguauugguuugaaggugggcguucucgaaaucaauaaauacgagguggacguacuggggaacuaucacaaggucaaacuaggaggcaauuga

SEQ ID NO: 2671 - RNA, 3198 nt, Artificial Sequence
  Cas9 variant
augaacaaggacaucaauuacgcccugggccucgauauugggauaaccagcgugggaugggcugucaucaaccuugaccugaauagaauugaggauuuggguguuaggaucuucaacgcagccgaaaaucccaaagacggcuccucuuuagcgcugccucggcgccuagcucgagggcguagaaggcuccugcggcgcaaggccuauagaguggagaggguacggaaacuuauugugaagaacaauauccugacaaaagaagaguuggaaggacucuuuaagaacaaggaggucauagaugugugggaggcacgcguuaaaggccuggacuacaagcugucacgagaagagugggccaaaauccucauuaauuucugcaagagaagggguuuuaaaaguaaccggaagaaugaaacuaaggauaaagaggcugggcagaucuuaagcuccauuucuuauaacaucgagaagaugaaagaaacgaauagccguaccauaggagaguacauuuauaacgaagugaaaaauucagacgauagcuacgcaccacugcgcaacaaauucggcgaguauaagaugugugucaguagagacgugcuuagggaagagauccacacauuguuugagaaacaacgggaacugggcaacaauuucgccuccgaugagauugaagacaaguacuuugagaucuucaacucucagcgaccguuuagcaauuucgaagaucuagagaagcucguaggguuuugcacuuucgagcgcaaaaagcauaaaagagcucccaagcacuguaucuccucagaagaguuuacccuguacgaaggaauuaacaaacuuaguauaaucaaggacggugagaagaggaaacugagcgaagaggagcggacauugguugugaaugaagccuucaacaagaaagagauuaaguauaccacucuccgcaaacuguuaggccugucugaagacgaacucuucuccacacuuaccuacucaaucgauaaggacauaagcaagacggagaauacuaaauuugucagucugaagggguaucaugaaauuaaaagagcgaucgagaagggagugucuaaaaaggcauggcaggauaucgaaaacaauaggaacuugcuaaaugacauugccuacgugcugacccucggcaagacagaugacgagaucgaaaaacagcugcgucuucggaacgucccugaggagcuguucgaauccuugcucgauaugagcuuuucgaaguucaauaaccugucuauuuaugcuuuagagaaaauacugccauuuaugaaggaagguuaccaauauaaugaggccugcgaaaaagcaggguacaacuucaaggcuaucuacgagggaguucgaacuaaaaagcuacccgugauugagaucgacgaaaucguaaacccuguggucaauagagcccucgcgcagaccaggaaggugauuaacuccguuauagauaaauauggcucaccagugcgcaucaauauugagcuggcccgggaccuugcaaagaacuuuaaagauagaaaguugaucgaaaaagagcagaaggaaaauagggcuaaccuggacaagauucgcgagaaucuccgagagcugauggacaaagaacccacagccgucgaggugcuuaaguaccggcugugggaacagcaacguggcgagugugcuuauacccagagucagaucgccuuggagagacucuucagcccuggguacugcgaaauagaucacaucauuccauuuuccaggucuuucgacgauagccugucaaacaaaaucuuaguacugggaagugagaaucagcgcaaggguaacaaaauuccguaugaauacuuuggcgaggacuccgaacgguggaauagcuucgagaucuggguuaaggggucuuaucuaaacuacaagaaaaaggcaaaucuccugaaaaagaaauuuacggaggaagaacaaagagauuggaaggccaggaaccuucaggacacuaaguacauaugucgauauauuucaaauuucgugaacaaccgcuuggaguucaaagagagugaaaauaagcagaaagucaucacagugaacggacgggcuaccgcguaccugagaucgagguggggccucaauaagguccgugaggauggugacaaacaucacgcacuggaugccgcugugguuggggugacuacacaaggcaugguacagaagauuuccaaauauucuaaggcccacgaguuauacaccguccgcaagaacgacgaauuuguggauguugagacgggagaaugcguggacgucgaugaguauaaagaaauccggaaggacauacugcccagaccuuggaggggcuucucggaggagcuuaaauugcgacucagcgacaauccacuggaggagcuaaagaaacugcccaucgaaaccuacaacgaggaguuuauuaaggaaaaugugaagccuaucuucguaucccgggugccauuucgcaaaauuucagggaaacucuucaaggagacaaucuauagugaaagagcauuuaaggauggauacuucguuucuaaaaagagccuggucgaccuuaagaggggugauuuggacaacuuuuacaauuaugagugugauaaaaagcuguacgacgccauauccgaacggaugaaagaguucaacuauaauggcaagaaggcuuuugagucacccuuccgaaagccgacuaagagcgggaaagaaggaccuguggugagaucugucaagauuaaauccgccgcacccuuuaaggauggcaucccaaugaacgaggguuuaguugcgaaagaagggauggugcgcaucgacauuuacgagaaggaaggcaaguauuucgugguaccugucuacagguaucagcucgcuaaaggaaucgugcccaagcgugccgcaauugccggcaaaagugagcugaaguggccaauaauggaucagaccuacaauuucaaauuuagcaucuucaagaacgaccuuauugagaucaaauacgcuaagaaggauggguauuuuggauacuaugacgguuucgaucggcauacagccucucugguuauugaaaaucacgacaacuccgacagauacaggggcaucggggugaaaacuggagucguggaguuuaacaaguaugaaguugauguguugggcaauuaccauaaaguaaaccucggugggaauuga

SEQ ID NO: 2672 - RNA, 3201 nt, Artificial Sequence
  Cas9 variant
augagcgagagaguggucaggcggauccugggcauugaccucgggauagccuccugcggaugggguguuguggauaucucuggcgcugggggaggcauuaucgcaaccgguguacgcuguuucgacgcccccuugauugauaagacaggggaaccuaaaucagcgacucgacguacggcuagaggacagaggcggaucgugcgcagaaggcggcaacgcaugaacggcguccgaagacuguugugcgaguuuggcuuacugccagacccgaggcccgaugcccuaaaucaggcaaugcggcguauaaguaccgccagcgcugcagcccaggugacaccuuggacucuccgcgcugccgcgcaccagagacugcuuuccaacgaggaacuggcaguuguguuggggcauaucgccaggcaccggggauuccgaucuaaugcuaagaacgaagccggugcaaaugcugccgacgagaccucgaaaaugaagaaagcgauggaggccacacgcgaaggccucgcaaaguaccaugcuuuuggggauaugauugccaacgacccaaaguucgcuaauagaaaaaggaaccgggauaaggacuauucacacaccgccaaacgcagcgaucuggaggacgaagucagagcaauccugagggcccaacuccguuuuggaagugcugcggcaacugagacauuagcccagaccuucgcugauguggccuuuuuccagcggccccugcaggacuccgaggaccgaguaggcgauuguccuuuugaaccaggucaaaagagagcagccaggcgcgcucccucuuucgagcuuuuucgguucuugagcagacuggccaaucuaaaacucgcaguugggagguccccugaacgccgacugacggcggaggaaauugcucuugccgcaaagggauuuggcgagacuaagaaaaccaucacauucaagucacugcgggaggccuuggaccucgauccaaacgcucguuucaguggcauagggaaagacaaggaagccagccuggauguggucgcaagaacuggaggugcugccuacggcaccaaaacauuaaaggacgcgcugggggaugccccguggaggucucucucccgcacccccgagacgcuugaccggauugcugaaauccugucauuuagagaggauauuacuagcaucaggaauggauuggaagaccuaggccuggauagucucgugguggaggcacugaugcaggccgcugccaacggugacuucaaagaguuuacacgagcagggcauaucucugcgcgcgccgcucggaauauuauaccuggccuuagagaaggacuggucuauuccgaggccugcgcaaggguuggcuacgaccacgcugcccguuugagcgugccacucgaucagguagggucgcccgugacccgcaaggcacugucugaagccuuaaagcagguccgggcuguggcgagagaguauggaccuaucgacuacuuccacauugaacuggccagguccguugguaaaucagcagaggagcgaaagcaacuaacugauggcaucgaagcucggaacguggagaaagccaagcgcagaaaacaggccgaggaacaucucgggagggcuccaagugacgaugagcugcuucgguaugaauuggcaaaggagcagaauuuuaaguguauauacagcggagacgccauugaucccgcgggcgucgcugccaacgacacacgauaccaaguggaucacauccugccgugguccagauucggugacgauucuuaucucaacaaaacccugugcacggcacgcagcaaucagaacaagagggggcguaccccuuuugaaugguucgaggccgacaaaacagauguagaauggauggaguacguugcucggguggagaaucuucaggaagucaagggcaggaaaaagaggaacuauucaaucaaggacgcagccgcgauugaggacaaauuuaaggcucgcaaucugacugauacccagugggccacacgauugcucgcagacgaacugaguagaauguuucccccacgggagugugaaagggccaucugcggacgcgcugauggcgggaacgacggauuaacuauuguggaggagcguagagucuucacccggccuggugccauaacauccaaacugaggcgcgcauggggccuagaagggcucaagaaacaagauggaaagcgaguggaggacgauagacaucacgcuguugacgcccuggugcuugcggccaccacugaaagccuucugcagcggcucacgguagagguccagaggcgcgaaagagagggcaggcccgaugacaucuuccacugugcagagccauggcgggguuuucgugcugaugugcgccgaacaguuuacgggucugaaaccaugcccggcauuuucgugucaagagccgagaggcggcgcgcuagaggaaaggcacaugacgccacuaucaaacagaucagggaaauugagggcgagcggcuggucuucgaacgaaagccuguggagaaauuaaccgauaaggaccuggagaaaauaccaaucccgaagcccuaugggcaaguaagugacccuaaaagacuucgcgaugaauugguggaaagccucagggccuggauugcugcgggaaagccaaaggaccggcccccucuguccccaaaaggcgauguuauccguaaggucaggauucagacaaaugacaaagugucuguggagaucaacggugggaccgucgauagaggagacauggcacgcguugauguguuucggaagaaaaauaagaaggccgugugggaguacuauguaguccccauauacccgcaccagaucguggcucuaaacgacccuccagaucgagccguuauugcauacgccgaagacaaagauuggaaggagaucgacucgagcuaugaguuccuguggucccucuuuggccugucauacguggaaauuaguaaagcuaauggugaaugcaucgacggcuauuucagagggcuucauaggggaacuggcgcggccucugucuguaagcacauuagcuuggggaaagaugcaacaguguccggaauaggccugaagacguuagcuucauuuaagaaauucaccaucgaccgccucggucggaaguuugagauucccagagagguucguacuuggagaggggaagccugcacauga

SEQ ID NO: 2673 - RNA, 3201 nt, Artificial Sequence
  Cas9 variant
augagccaccuggugcucggccuugaccuggggcccaacuccaucggaugggccuuggucaaugaugacccugagcauccaguugaaucuaaguuaguggaucuggguguaagaguguucccggagggcgucgacaacuuugauaccucaaaagaacuaaguaggaaugaggaccggcgcguggcucgagggaugcguagacagauuaggcggcgcgcaagaaggcggcaacagcucaagcaggcccugauagauagcaaacuuuggcccuccgacccuaacgaugaaguugugcuguacaauacaaacccauaugaguugcgcgcgcgagcucucaaggagagacuggaaccccacgaggucggaagggugcugcuccauuuaaaucagcggcguggcuuccugucuaaccgcaaaaaggacagaggugauaaggaaguacaagggaugcuugccgagaucaaugagaacgaacagcagugcaaagacggaggcuuugauacuauuggcgcaugguuggccgacaagcaggcuaauaucgaccacgcaaacagggaggaaaaugaucauguucggaaccgacaccuggcccgcucgcaauacguggacgaguucgaagcuauuuggucaguccaggccaaacaccauccuaagcuacucacggaggagcugaaaguggggaaacuuggaaagcagaccuauccagugaagcccaucccuagauggcacgaacauaggcagggucugagcccauuggagaguuuuggcauauacgggcucaucuucuuucaacggccgauguauuggcccaaguccgucguuggacugugugaauuagagccuaaagaacgcagaugccagaggucugaucgucggcagcaacgauucagacugcuccaggaggugaauaaccuuaaguacguagacccagauacacaccuggagcagaaauuggacgauaagcagaggcgccuacugcucgacaaacugagccacacuaaggaaaugaccuuugaucaaauucggaaggcgcuugacuuccuggaguccgugaaauuuaacuuggaaagaggcgagaggucacgccucaaggguguccccaucgaugcacuguucgccgcuaaagacguguuagggcaggaaugguaugaccgaccugagcagcagaagacagagauuguugccgugcugcuagauaaugaacgggacgaugaccguaucauagcaagagcugucgccgaguggggaaugaccgcgaaagaagccgaggcaaugcucggcguggaucugccagcuggcuacgccaaccuuaguuguaaggcuauugagaaguugcugccccauauggaaagggggcuccuguacauggacgaugacgagagcaauucugccaugcacgcagccggauaucuucgccgggaucaacugagaaggcgaaucuuugacguauugccggauccugcucgcacucccaacugcccaauuggugacaucccuaaucccguugugaaacggacacucaccgaaaucagaaaggucgugaacgcgauugucagggaguacggcaaaccagaugcaauacaucuggaauuagcccguuccgugcagauggggaaggagaaacgcucagaguauagcaagaugauccgggacagagaagcugagagggacggaauuguugaaaagcugcgagagaguggcgugcggguaacgcgcgauaauauccuaaaauaccagcucugggaacagcaaaaccaggaguguauauauucugguaagcccauuuccuucgagaaacuguucggggaaggcggaggcgucgagguggaccacauccuuccuagaagcaggucguuggaugacucucaggccaauaagaucguuugccugcggacugcaaacgccgggaaaggagaucagaccccauacgaauggcucgcugacacacaaccgaagcaguaugaacaggugugucaacgagccgguaugcugaugagauccggccgcaugcccuacgcaaaguacaggcguuuuauucagcgggaguuagagcuggauaaauucaucgcgagacagcuugcugacacuggguauauuaccaaggccacaauggaguacuugagguaucucuuugauaaagaccaugauguccugggacuaaagggccagcugaccgcagaacuccgcuaccacuggggucuggagacgauacuugaagaguugccugacucaccagccuggcacgaggcugauagugggaaacugcgacccggcgaaaagaauagagccgaccaucggcaccaugcaaucgacgcugugguaauugccuuaacuaacaggcgccgucucgugcaacugagcgauaucguuaaaagaggaggcgcgcgggcccacggggagauccuugaagacccuuggccaaauuucagggagaacgucgugcaggcuauuaagaagacaaaugugucccaccgcgucgaacgaaaaguugcaggaaagcugcaugaggagaccuuguauggucccacuagaacaccgggcgaaugggugcuccggaaaccugugauagcccugucugcuaacgagguagaaaggauccgcgaugccaccauuagacagaucgucgugagcgcacuagcggacgccgggauugauguuggaaggggcaagaaaccagacgcuaagaagaugaaagaggcccugucaaagcucaaaaugcccaguggugugccuauccggaagguccgucugacgaaacccgaacagaccauacaaccagugcgcgcagggcgaccugaucaggcuuuuguuaagcccggcuccacacaccaucuuugcaucuucgaguuuacugagaacggaaagaccaaaagagacgccguguucguaacaauguuggaagcaaugaauaggcugaagcggcgcgagccagucauucagagaacucacccggaaaggccugauagccgguuugugaugucuuuaucagcccgagagaugcuccuggcuaacuggaaagacggcgaaagacuucugaccuucaagacagcgaguagcacccaggggcaaaucugguuugccgagcauacugaugcacgcaaauccgcugacuacaagcaguucguggccaaugccaacacgcuagacgcuaagaaagucacaguugauccccucggaaggauucggugggcaaaugacuga

SEQ ID NO: 2674 - RNA, 3204 nt, Artificial Sequence
  Cas9 variant
augggcacuagacuggggcucgacaucggaacaaacagcauugguuggugccuuuucaaucuggauggcuccgggaggcccauaggaauccgggacauuggcgugcgcaucuuuucugauggucgagacccucguucaggggccaguuuggcugucgagagaaggguugcacgggccaugcgcagaaggcgggaucgcuacauucgaagaaggagcgcguuacuggaagcucuaaucaacacuggacucaugccagccgacgugcaggaguccaaggcacugacgggcugugauccguauguacuucgggcccaagcucuggaccgugcauuggaugcccaccuccugggccgcgugcuguuccaucucaaucagagaaggggguuuaaaucuaaccggaaggcugaacgaaaagccggagacgauaaggaggguggcaaaauagcggacggggcaaaggccuuagaucuggcuaugcacgaagccggagcacgcaccuacggcgaguuccuugcugguagagacucgaggcggguccgcuugagagccgagggggacggauaugauuuuuaccccgaaaggcgucaucuggaggcggaauuugacgccaucugggaugcacaggcugccuauaauccugcucuacucacagacgugguucgggaucgacugagaaggauuaucuuuuuccagcgcccacuuaaggcccccaaagugggcggcugcacuuucuucaacgaggagccucggcugccaaaggcacaccccuuguuucaagaaagaaggcucuacgaggaagucaaucagcuggagauuacccgcgccggggcuccuucacgaaaauuaacacuggaccagcgggauaagaucauacguaaacucaagagcgcgaagaccgcaaguuucuccggacuugccagacuguugaaacuagcugacggugaaucuuuuagcagggugacugagaaccgcacaggccuggccggggaugacauuuucaccuccuucucagauaagcgguguuuuggagacagaugggcacauuucgacccaggcguacaguggaguaucauugagacgguuacugaagaggaagauccggugaggcuccgagacuggcugauggccacccacggugucacaguggagcaagcugaagccaucgggcgcgugcggcuucccgagggccacggaagacugggcgagacugcaagcagguugauccucgcgcagcugaaaucuggguccaaggauggacauccuuuaaccuauaaugaagcugucgaggccgcacuggguaaaucacacagcgacuuucguacaggcgaaauucuagagcagcucccauacuacggggaaauacugagucgcgagauucccccuggaucucuugauccagacgaugacgaugagauccgguggggcaagaucaccaaccccacgguucauauagguuugaaucagcugagaaggcuccugaacgcccuuauuaaagcucacgggcgaccggacgaaaucgugguagagcuggcccgggaauugaagcucuccgagaaggauaaagcagagcacaaucgcagaaucggcgcuaacacuagggccgcggaagcccggagcaagaaacuguuagagucgggacaaccugacacaggcgcuaaucgaucucugcuaaagcucugggaagaucugaaccccaacaauccacuugacagaugcuguccuuucugcgggcgccauauuggacagauggcauuguuuuccggugagaccgaaaucgagcacauuauacccuauucaaggagucuggacgauagcgccgcuaacaaagugaucgcccaucguuccuguaaucgggagaagggcaacagaacuccaugggaagcaugggggcacacagagaggugggcgauuaucgccgaacaggucucucgccuccauaagagcaaacaauggcgauucgcucccgacgccaucgagagauuuaaucaggaaggaggcuucauugcacggcagcugucagauacccaguacuuaaguaggauggcucgcacguaucuguccagccuuuacccugacaccgccgguguguauguuauaccagggcguaugacagcaauguugagacggcucuggggccugaacgagcuacugccggaucacaauuacguggagaacccccacucuggagccccuaagaauaggcucgaccaucgccaccaugcuaucgaugcggccgucgugggcguaacuacccgagggcugcuuaacgaaauuucaagagcagcuggacgggccgagaggcaagacuuggaucgccuguuuaucgacuuaccaaaacccugggaaacauucagagaggaucuccacgaaagucuggccaggguugugggcagccacaaggcugaccauggucggaaaggggucccugcaaagggaaaggaugccacugcggcucgucuucacaaugagaccgccuauggccugacagguuugaccuccgagucuggccucccaauugugguccaucgcgugccccugcuaucgcugaaaccggacgaccucagcaacccuauccgaauaccagaugcagcccugcagagagcucuuagggaagcaacugacgggaaguccggaaaagauuuucaggaggccuuggcgcaguucucaaagagugaccccguuuuuaaaggcauccggcacgugcgcguaagagaaacgcugaaggucauuccuaucagggaugcuucugggcaugccuucaaggcauacaaaggagacgccaaugcucgguacgauguguggcgaaugcccgacggcaaguggguuagcuccuggagagaucgcgacgguaaagcccacucagggauuaucacaauguucgcagcucaccaagccggacagccagugcagaggccucaucccgcggccaagcgggucuuaagccuccgucagaacgaucugguggcaguagagccacaaggccagccgagaaaaauaaugagggugguuaaguuuucuuccgguggccagauuaccuucgcugagcaccaggaagccgggccucuuaaagcucgcgacgcaaccagucccgacaucgauccauuuaaguauuucuacagcucugccggaggccugcaaaaggcccgggcucgacagauuagaaucgacgagcuagggaggauauuugaucccggaccucgcuga

SEQ ID NO: 2675 - RNA, 3207 nt, Artificial Sequence
  Cas9 variant
augaaguacgugcugggccucgacaucgggauugccagcugcggaugggcugucauaaaccaggagaaacacagaaucgaagaucuugguguuaggauuuucgacaaggcagagaaucccaaagauggcaagucccuggccaccccucggcgcgacgcgcgaucuacacguagaacuuugaggcggaaaaagcaucgcaugcaaagaaucaagauuuuacuggugaaacacgggcuacucucaaagacggaaaucgaucaucuguaugagagugcuaccgaaauagacguaugguaccuuaggcugaacgccuuggagcggcgccucaauccaaaagaguuugcacgagugcugauccaccugagcaagagaaggggauucaaauccaaccggaaggaaacaacucucucugagaauggccagauuuuagaaaacaucucggagaaucugcagauuauggagcagaagaacuaucguaccgucggugaaaugauccuuaaagauaagcgcuuugagaaucauaaaagaaacaaggacgggacauacauaggaaccgugacuaggcaacaguugcaggaagagauucagaugaucuucaaugcccaacggcuguauaaaaacaaucacgcuacagaaaaguuugagucaagcuaccuagagauuugggcaagucagcgaccguaugccuccaaagaucagaucgaaaagaugaucggcuacuguacccucgagcccaaggaaaaacgcguuccuaaggcuucuuggagcuuccaguacuuuguggcccugcaaacgauuaacaaucuuagacugauauccaaagacaggaucgaggaauugucauucgaggagaagaaacggauuaugaaccucgcgcuggaaaagaguaucgucaaguauauagauauucgcaaauuacugagcgugccaaaggaguuucaguucaacucucucuccuacucagcagacaucguagauacuaccguugaaaauaaaaagugcaucgagcuuaaagaauaucacagcauuaacaagguguacaagcagaucuauggccaaaaugcccugaacuugcuacccaaagacuacgacacaauugcuuaugggcugacuauauuuaaggaugacaaagauauccaggaguaccuccagaauaaguacgucaacgccaaaggaaagccuauuaguaaucuggcaaacaagaccuaugacgauacauucauccaggugcuucugaccuugaauuuuucuaaaaugggucaucucuccuucaaggcucugaaaaacaucauuccauucuuagaggaaggccugagcuacgacaaggccugugagaaagcgggguauaauuuuaagggaacgucguacacuaaaaagacaaaguaucuacccgugauaccucaaaacaccaauccagucguucacagagcccucucucagacuaggaaagugaucaacgcaauuaucaagaaauacggcuccccgaaugcuauucauaucgaaacagcccgugagcugucaaagaccuuccaggagcggaaagaaauagauaguauguaucaggacaacagcaagaagaacgagcacgcuaucugcaaacuuaaggaauuggguaauauuaaccccuccgggaucaauauuguaaaauuuaagcuguggaacgagcaagauggacgauguauguacacgggcaaauacaucgaaccucacagacucuucgaggagggcuauaccgaaguggaccauauacugccauacucuaggagccuugaugacucauauaauaacaagguccugacauuggggacugagaaucagcgcaagggaaacaaaacccccuacgaauauaugcggaauaacaguauuugggacgaguuugaaacaagagugcaguccaauaagaaaaucaacaagaaaaagcagcaaaagcuccuguuacagaauuucagccacgccagggagcaggaguuuauugaacgcaaccugaaugauacucgauacgcaaccaucuaucuaucuucacucauacagcaacaucugaucuucagugagagcucccgggagaaaaagguucacacagugucugguauuaucaccucgcaucuucguagcagauggggcuuuaacaaagacaggaaggaagggcacauucaccaugccuuggaugcugucaucguggcgguaacuuccgaccacaugauacagcgcguuacgaaauacuacaagcugaaagaacucaaccggaauagacaggcaaagaggaugcaauucccugagccaugggagggauuucgacuggaauuagaggcccgcauuucacccaacacacagcaguaucugaagggcauccgguucaaaaauuacgcugaugugaaccuuagugaaaucaagccgauuuuugucucuagaaugccuaaaaggagcaucaccggugaguugcaucaggagacuauucguaaguuccucggguauaaugaaaaaggcaaggugcugaccgccacaaagaccaaacuagaggacauacccuucgaugcaaacggagacuuuccaauguucggcaaggaaacugaucuguacacauauaaugccaucaaagagcgcuaccucucccacaagaaagacaagucaaagagcuuucaagaaccucuguauaaacccacgaagucugggggaauugguccacuuaucaaauccauuaagaucauggauacccggacuauagucaaccccgugaaucagggcaaagggguuguguacaacaguaagaucgcuagaacagacguauucaagaaaggagagaaguacuauuugauuccuaucuacaccauugaucugaugaaaaauacauuaccacagaaggccaucacugcaggcaaagguuaugaggacuggaccacgauagacccgagcuuuaccuuccucuuuucucuguuccccaacgaucuuauucagaucgucccuuccaagaauaagacaaucaaagcgaggacuaccgugucaaagaaagaaguucuguugccaagucucacaggguacuuuaagggcgugcacagcggaacugcuggcauuaccgucgagacgcaugacgggucgauaaucgccaacgugggauccaaacaacugcuaucuuucgaaaaguaucagguagaugugcugggucacuacacaaaaauuaagaaggagaaacgaaucggcauggcaauuuga

SEQ ID NO: 2676 - RNA, 3207 nt, Artificial Sequence
  Cas9 variant
augaacaaggccguggcuuacagacuggcacucgaccuuggcagcaccucccuggggugggccaucuucagguugaaugaggcgcgggaacccacagcuauuauacgcgccggaguccgaaucuuuucugauggucguaacgcaaauucagagccuuuagccguucacagaaggguggcucgggcaaugcgcagaaggcgggaccgccugcuaaaacgaaagaaaagaaugcaugaucagcucguacaacacggcuucuuuccagccgaaguggcugagaggaaggaacuggagcggcuuaacccguaucagcugcgugccaaaggguugcaugaggcgcucacucccggagaguucgcacgcgcccuguuucacauuaaucagagaaggggcuucaagaguaaccggaagacggaccgaaaagauaaugacagcggugcucugaagcaggccaucuccgaacuccgcaaaaggauucaagauucugacugcgcaaccgcuggggaaugguuuuggaaggagagaaugcagcagaaaccugagggaguccggggccagugggugcgcgccagauacaggaagacaccaucgacuaccgaugaaggcaagaaacguaucggguaugacuuauacguugaucgggcgaugguggagcaagaguucgacgcccugugggcagcucaggccgcccuucagcccggauuguuuacagaagcugcacgagccgaacugaaggauacccuacucuaucagagagaccugaggccugucaaaccaggucgcuguacucuucugcccgcugaggagcgggcgccuuuggcacucccaucaacacaaagauucaggauacugcaggaagugaacaauuuacgccugcucgacgaggcccuucgagaaguaccgcugaacuuggcucagcgggaugccguugugagcgcacuagagggcaagaaagaacugaguuuugccgcuauccguaagcuccugacccuuuccgggaaauucaaucuggaggacgagaagagagccgaauugaagggaaacgcaacgucugucauucucgcgaggaaagaucuguuuggcgacgcuugggccgguuucgaugcagccgugcaagacgagaucguguggcgcuuagucagccaggaauccgagggggcucugauugccuggcuacagcagcauacuggaguugauggcgugugcgcagaagcuaucguaaauacccggcuccccgacggcuacgggagacugucaaggaaggcccuugagcgaauagugccugcguugcaacgcgaggucuguacauaugauaaagccgugcaggcugcaggauucgcccaccacagugaccuggguuuugauuucgacuacgcugaagacgagguucaacaggugggcgaacauacuauugccagcaccggggagguccaggcacaguacgcguuuaagcagcucccauauuacggaaaagcccugcagcggcacguggcuuucggcucuggugaugccaaggaccaugaggaaaagugcuaugggaaaaucgcaaaccccacaguacacauuggccuuaaucaaguuagaaccguggucaacgcucugaucaggcguuacggacacccuacggagguggucguggaauuggcccgcgaucucaagcagucccgggagcagaaacagcaaacucagagagaacaggcagacaaccaaaagaggaaugaggauauccgaaaacggauugccccaauacuggagacaucacccgaacgcguuagagacagggauaucaagaaguggauuuuaugggaggaacugaacaaaaaggacaucgcugaucggcauuguccguauagcggcgagcgaauaagugcgaccaugcuacucucugaagccguggagauugagcacauccugccuuuuuccagaacucuugacgauagcuugaauaaccgcacaguagcaaugaggcgugcuaaucggaucaaaggggacagaacccccugggaagccagggccgauuucgaggcucagggauggcgcuacgaagcaauucugcagcgagccgaggguaugccaccuagaaagcgguauagguuugcggaagacggcuaccagcgcuggcucgggaaagaccguaacuuccuggcuagagccuuaaaugauacgucguaccugucucggcuugcagccaacuauuugaggcucgucugcccccaaggagugcgcguuaucccaggccagaugaccgacaagcugcgagguaaguuugggcuaaauuccgugcugggccucgauggcaaaaagaacagaaaugaccaucggcaccaugcugucgaugcaugugugauuggaguaacagaccaggggcugaugcagagguucgccaacgcgucaaaacaagcucgcgagaauggacuuacuagauuggugcaggauaugcuguuacccugguggccuaguuacuaugaccacguugagagggccguccggcacauacgugugagccaucgcccagaucacgguuuugaaggcgcaaugaugaaggggaccgcccauggaauccgagaggacggcauuagagaagaugguaggaucaaacagcggccgaaggcuaaaggguccgccgaccacaagacaaucacucucauucccauagaugagccucgccagcuggcaagacacggcguggacgcugagggaaagccacuucccuacaaaggcuaugccucugggagcaacuacugcaucgaaauuaccaagaauggaaaaggcaagugggagggucaagucaucucaacauucgacgcguauaggauuaaagccgcagcugaugccgcugcacgggccgggcagguuaucaguaccguggaagccgacuccauagugcgaaagagcggaugggagagacugcgcggcgcucagucucaaaacggucagccuuugguaaugaggcucgucaucggcgauucagugcggauggaaguugacgggcgugaugaggugaugagagucgugaagaugaguggaaaagagaugguuuuugcgccagugagggaagcaaacguagacaagcgcaauaacaugcccgaugagcaggacccguucacuuacacguacaaacgggccgaucagcugcgaaaggcuaaagccagacaagucacaauuagcccuaucggcgaacuaagggacccaggguucaagggauga

SEQ ID NO: 2677 - RNA, 3207 nt, Artificial Sequence
  Cas9 variant
augcaguacgugcugggccucgacaucgggauugccagcugcggaugggcugucauaaaccaagagaaggaaagaaucgaggaucuugguguuaggauuuucgacaaagcagaaaaucccaaggauggcaaaucccuggccgcgccucggcgcgacgcucgaucuacccguagaacauugaggcggaagaaacaccgcauguuaagaaucaagauucugcuagugaagcaggggcuccugucaaagaacgagcuuaaucaucuguaugaaaguacuacggagguagauguguggaacuugaggcucgacgcccuggagcggaagcugaauccaaaagaauuuacccgcguccucauccacuuagcaaagcgaagaggauucaaaagcaacaggaaggagacaacucuguccgaaaauggccagauacuugagucuaucucggagaaccagcaaauuauggaacagcagaauuaccggaccgugggugagaugaucuugaaggauaaaaaguuugaaaaccauaaacguaauaaggacgggacauauauuggaaccguuacucgccagcaacugcaggaggaaauccagaugauauucacagcccagagacuauacaaaaacgauuaugcuaccgaggaguuugaaauuucauaccucgagaucugggcaagccaaaggccguaugccaguaaggaccagauugagaaaaugaucggcuacuguacgcuggaacccaaggaaaagcgggugccuaaagcauccuggucuuuccaguacuuugucgcccuucaaacuaucaauaaccugcgauugauuagcaaggaucgcauagaggagcucuccuucaaagaaaagaaacagaucaugaaucuggcguuagagaagucaauugugaaguauaucgacauaagaaaacugcucaguauuccaaacgaauuucaguucaacagccuuucuuacuccgcagauaccguagacacaacucuggagaauaagaggugcaucgaauugaaagaguauuacucaaucaacaagguuuauaaacagauuuacgagaagaaugcccuaaaccugcuccccaucgacuaugauaccauugcuuacggccugacaauauuuaaggacgauaaagacauccuugaauaccugcaaaauaaguaugugaacgccaaagggaagccuauuaauaacuuggcuaaaaagaccuacgauuauacguucauccaggcucuccugacuuuaaauuuuacaaagaugggacaccugagcuucaaagcccuaaagaacaucauuccauuccucgaggaaggucugaguuacgacaaagcgugugagaaggccggcuauaauuuuaaagggaccucuuacacugagaagacaaaauaucuucccgucauaccucagaacaccaauccaguggugcaucgggcauugucccagacgcgcaaggucaucaacgcuauuaucaagaaauacggaagcccgaaugccauucacaucgaaaccgcuagagagcugucgaagacauuccaagaaaggaaagagauagauucuauguaccaggacaacuccaagaaaaacgaacacgccauccauaagcucaaggagcugggcaauauuaaccccucagguaucaauauuguuaaauuuaaacuuuggaacgagcaggaugggcguugcauguauaguggaaaauacaucgaaccucaccggcuguucgaggaaggcuauacugagguggaccauauauugccauacagccgaucccucgaugacucuuauaauaacaagacccugacauuaggcacugaaaaucagagaaaagggaacaagacccccuacgaguauaugggaaauacaagcauuuggaacgacuuugagaccaggguacacucaaauaagaaaaucaacaagaaaaagcaacagaaacugcuacuccagcacuucaguuacgcacgcgaacaggaguuuauugaacggaaucugaacgauacuagauacgccacgaucuaucuuuccagcuugauacaacagcaucugaucuucucugagucaaguaggaagaagaaagugcacacagucagcgguauuaucaccucccaucuccgcucucgauggggcuuuaauaaggaccggaaagaagggcacauucaucacgcucuggaugcggugaucguugcagugacuucggaccacaugauacagcgugucaccaaguacuauaaauuaaaggagcugaacagaaaccuucaagccaaaaggaugccuuucccagagcccugggaaggauuucgcuuggagcucgaagcucggauuagcccgaauacacagcaguaccugaagggcuucagauuuaagaacuaugccgaugugaaucuauccgagaucaaaccuaucuucguaucaaggaugcccaagcgaaguauuaccggugagcugcaucaggaaacuauccgcaaauucauuggguacaacgagaagggcaaaguucucacagcaauaaagacgaagcuggaagacaucccauuugaugccaauggagacuucccuauguauggcaaagagaccgaucuuuacacuuacaacgcuauuaaggaacgguuuuugucucacaaaaaggacaaaagaaagagcuuccaagagccccuguauaagccaacaaaauccgggggaaucggucccuuaauuaagucaaucaaaauaaucgauaccaggacaauugugaauccugucaaccagggcaaggggguggucuacaauagcaaaaucgcccguacugacguguuuaagaaggaugagaaauauuaccucauuccaaucuauaccauagaccugaugaagaacauucuuccgcagaaagcaaucacggcgggaaagggcuacgaagacuggaccacaaucgaucccucuuucacuuuucuguucuccuuguuuccuaaugaccucauucagauaguuccaaguaaaaacaagaccaucaaggcucgcacaacugugagcaaaaaggagguacugcuacccucucugaccgguuauuucaaagggguccauuccggcacggccggaauuacaguggaaacccacgauggcucaguuaucgcaaauguggggaguaagcaacuccugcuuauugagaaauaccaggucgacaucuugggacacuacacuaagauaaaagaagagaagcggaucgguauggccauuuga

SEQ ID NO: 2678 - RNA, 3207 nt, Artificial Sequence
  Cas9 variant
augcccaagagcgccaaaccucagcaggcuuacacccugggccucgacaucgggauugcauccgugggagccgcgcuucugggucaacagcacauaaucggcuugcaugucagaacauucgauagggcugagacugccaaggaaggggagccauuaaacaaaauucggcgcgacgcacgacugacgcguagaaggcuacagcggcgcgcccacagacuccugaggcuucggcgccuguuuaagcgacauaauuugaucccggauaccgacacaucuacuuucauuucaggacaaagucccugggaacucagagcucagggccuggauaggcagcugaccagcgcagaguggacaaccguucucuaucacaucgugaaacaucgggguuuucacuccaaccguaagucugaaguaaagacugacgagaaagccgggcagauguuaucgggagugaaucaaaaccaggcucugcuuaagcagucaggcuugcgcacaaugggcgagcuggccgcgagacacgaagcauucagggaggccaaacggaauaagaaaggggcuuacaaccauaccuuuagccgacacgaucuagaagacgagcuccaucugcuuuucagucgccagagagagcugggaaauccuuaugccacgccagaauuggaggaugcaguccacacucuccugaugcaaaggcggcccgcuuuauccgguaccaaccugcucaagauggugggccacugcacacuugaaccugacgaguuucgcgccccaaaggcgucuuacacugccgaaagauucauauggcugaccaaauugaauaaccuaaggguuagcggguccggagagacacguccccugaaugagucagaacggcaggcacuccugaguaagccuuuuagccagucuaaacuuaccuauaagcaagugcgaaaaauccuggaguugccagauaacauuagauucgucggccuccauuaccacccggcucaggacaaugguaagucccccgaaaacaggguguuuuucgaggccaaggcuuuucaugcccugcgcaauguauauaaaaaggcaggguuaaaccuggaauggcagcgggauucacagaacccugagaaacuagacaauaucacguacgcccucacuguuuucaaggaggacaaagaagcuaagcaauggcugauugagaaaggaguggaagcgagcgucaucgaggcagugcuuaacgaaaguuucucugaguuugugagauuguccauaaaggcccugaggaagauuaucccacacauggagauuggccaucgcuacgaugaagcugucaaacucgccggcuauagccaccacucgcaucugccccagccuucuaagacaccauacaucccccgauucuccaaacagucaaucgcaaauccgguugugagucgggcccuuaaccaggcucguaagcugguaaaugccauugugagagaguaugggccucccgacgcaguccacauagaauuggcgagggaucucaacaaaccauuugacgagcgccggaagaucgagaaggaucaagaaaaauaccagaaggacaaagcuagagauauugagaccuuccaggaaaauuuuggauucacuccuaagggucugcaguuaacaaaauggaggcuguaucgagagcaaagcggcaagugugccuacucccuaaagccccucgacaucaaccgccuguuugaagauggguauguggagauagaccaugcacuuccauacucucggagcuucaaugauggaaugaacaauaaaguuuugacccugacgaccgagaacagaaauaagggcaaccagacacccuacgaauaucucgacggugccucaaauagugcucaguggaggaacuuuguggccugggucaacuccaauaaaagcuaccgugcaucuaagcagcgcaaccuguuacggaaagacuucgcugcccaagcggccacugaguuuagagaaaggcaccugaccgauacacgauauauugcucgggaguucaagcgcaugguggaaacucaccuuaaauugaauaagccuaaccagagaugcguaguugugucagggcagcucaccgcauaccugagggcccgguggggccuaaucaagguccgagagaauggagaccugcaucacgcucucgaugccgcaguggucgcggccuguagucaugcuauggugaaaagacuggccgacuauagccgcaggggcgagcuucaauacgcacgugggcaccauuuugauccagaaacaggagagaucauugacaucaacgcuuugcggaagcuggaugaccacuucccgcagcccuggaccgauuucagaagggaauuacucgccuggcuguccccugacccagcacagcagcuuaaaaaucuggccuauuacacugaugagcgcuugaagcaaguuaaacccauucgagugucuagagcuccuacgcggaggggucucggcgcggcccaccaggaaacaauacgcucggcaaaguaccugggggagaaccguagcaccguaaagacuccacuagagaaacugaagcucaaagacauccccaauauugucggauaugaagauccgagaaaccaucagcugauccaggcuaucucccaacggcuuaccgagcacggcgacgacgguaagaaagccuuuaaggaaccuuuguacaagccagggaauaacaaaucaacagcccccgugguuaggagugugaagcuguucaccguccagaaaucuggcauuccugugcgcggaggcauagcuaauaacgggaauaugguacgaguggauaucuuuacuaagaaagagagauauuucgcaguucccgucuacgugagcgacgccgcgcggaacgaguuaccaaacaaggcuguggccaggggaaaggaugguuggauugacaucgaugacuccuuuucauuccucuuuagccuguauccuaaugauugggucucuguuguggugaaaccccaugaagcaccaugcgagggcuacuaugccgggcuugacauuuccacaggagcuauccacauaugggcacaugaucgcaacagaaguguaggcaagaauggucugaugaggagcaucgggauuaaaacggcccacucugucgaaaaguaccacguggaccuacucggcaaccuguaccggguugugcaugagacccguaaaccguugcgcgcgggaaaguga

SEQ ID NO: 2679 - RNA, 3207 nt, Artificial Sequence
  Cas9 variant
augcaguacgugcugggccucgacaucgggauugccagcugcggaugggcugucauaaaccaagagaaggaaagaaucgaggaucuugguguuaggauuuucgacaaagcagaaaaucccaaggauggcaaauccauggccaccccucggcgcgacgcgcgaucuacacguagaacucugaggcggaagaaacaccgcaugcagagaaucaagauuaucuuggugaagcagggguuacugucaaaaacggagcuagaucaucucuaugaaagugcuaccgagguagacguguggaaccugaggcuugaugcccuggagcggaaguugaauccaaaagaauuuacacgcguccucauacaccuggcaaagcgaagaggauucaaaagcaacaggaaggagacuacccuguccgaaaauggccagauccucgagucuauuucggagaaccaacagaucaugggucagaagaauuaccggacagugggggaaaugauuuuacaggacaaaaaguuugagucacauaaacguaacaaggauggaaccuauaucggcacuguuacacgccaacagcugcaggacgaaauacagaugauuuucaaugcccaaagacuuuacaaaaacaauuaugcuaccgcagaguuugaaaacagcuacuuggagaucugggccagucagaggccguaugcuuccaaggaucagauugagaaaaugaucggcuacuguacgcuggaacaaaaggagaagcgggcccccaaagcgucuuggagcuuccaguacuuuguggcacuacagacuaucaauaaccuccgacugauuuccaaggaccgcauagaagaacuuucauucgaagagaaaaagcagaucaugaaucuggccuuggagaaaaguauugucaaguauaucgauauaagaaagcuccugagcgugccuaacgaauuucaauucaacucuuuauccuacucagcugacaccguagacauuacaguugagagcaggaaaugcaucgaacugaaggaguaucacaguaucaauaaaguguacaagcagauuuaugagaaaaacgcccucaaucuucugccaaaggauuacgacacuaucgcauauggguugaccauuuuuaaggaugacaaagauauacuagaguaccugcagaacaaguacgucaaugcuaaaggaaagcccaucucuaacuucgccaauaaaacauaugacgauaccuuuauucaggcgcuccugaaccuuaauuucacgaagaugggucaucuguccuucaaggccuugaaaaacaucaucccuuuucucgaggaaggccugagcuacgacaaggcaugugagaaagcuggguauaauuucaagggaacuucguacacagagaaaaccaaguauuuaccagugauuccccaaaacacuaauccugugguccaccgggcccugucucagacacgcaaaguuauaaacgcuaucauuaagaaguacggcuccccaaaugccauccacauugaaaccgcaagagagcuaucaaaaacguuucaggaaaggaaggagaucgauaguauguaucaggacaacagcaaaaagaacgaacaugccauaugcaaacucaaggagcuggguaauaucaacccguccgggauuaauaucgugaaguucaaacuuuggaacgaacaagauggacguuguauguacucuggcaaguacauugagccccaccgguuguuugaggaaggcuauaccgagguagaccauauccugccuuacagccgaucacucgacgauaguuauaauaacaaaacacugacucuugggaccgaaaaucagagaaagggaaacaaaacaccauacgaguauauggguaauacuuccauauggaacgacuucgaaaccagggugcagagcaauaagaagauuaccaaaaagaaacagcaaaagcuguugcuccagcacuuuucuuacgcucgcgagcaggaguucaucgaacggaaccugaaugauacaagauaugcgacuauuuacuuaucaagucugauccaacagcaccuaauauuuagcgaguccucuaggaaaaagaagguccauacggugucgggcaucauuacaagccaccuccgcucccgauggggguucaacaaagaccggaaggaaggacauauccaccaugcacuggaugccguuauuguggcugucaccucagaccacaugauccagcgugugacuaaauacuauaaacuuaaagaguugaauagaaaccugcaggccaagaggaugcccuuuccugaaccaugggagggcuuccgccucgagcuggaagcacggauaagucccaacacccaacaguacuuaaaagguuuuagauucaagaauuaugccgauguaaaccugucugagauuaagccgaucuucguuagcaggaugccuaaacgauccaucacaggggaacuucaccaggagaccauucgcaaguuuaucggcuacaaugagaaaggaaagguguugacugcuauuaaaacaaagcucgaagacauacccuucgaugccaacggcgacuuuccaauguaugggaaggagacggaucuguacaccuauaaugcaaucaaagaacgguuccuaucacauaagaaagacaagagaaagagcuuucaggagccucuguacaagcccacuaagucuggagguauuggcccacucaucaaauccauuaagaucauagauacaaggaccaucgucaaccccgugaaucaagggaaaggagucguguacaacaguaagauugcgcguacagacguuuucaaaaaggacgaaaaguauuaccugaucccuauuuauacuaucgaucuuaugaaaaauauauugccacagaaggcuauuaccgccggcaaagguuacgaggacuggacgaccaucgauccgagcuuuacauuccuguuuucuuuauuccccaacgaccucauccagauugugccuuccaagaauaaaacuauaaaggcacgcaccacaguaucaaagaaagagguccugcuuccaagucugacuggguauuuuaagggcgugcacagcggaaccgccggcaucacgguugaaacacaugaugggucggugauugcuaacgucggauccaaacaguugcuccuguucgagaaguaccaaguggacguacuaggucacuauaccaaaaucaaggaagagaaacggauuggcauggccaucuga

SEQ ID NO: 2680 - RNA, 3210 nt, Artificial Sequence
  Cas9 variant
augaagaaacagccccaaagauacauccugggccucgaccuugggauugccagcgugggaugggcucugauauuggucgauggugcagagaacccuguuggcuuacuggacugcggggugaggaccuucgaacgggccgagguaccaaagacaggagauucccuagcgcucgcucgccgacaggcccguucugugagaaggcugauccggcgcagagcacacaggcuucugcgguugcgccgacuccugaaaagagaaggcauucugucagccgcugacuuuaauagugauggucucccgaacuuacccaucgacgcauggcagcugagggucgccgggcuugagcggaaguugacuaaucaggaaugggcugccgugcugcuacaucucguuaaacaccguggauaucugagccaacgcaaguccgagacgcagaccgagaacaaggaacuuggcagacuguuggcgggcguggcagaaaauucuaaacuccugucggagucaagcgagcaguacaggacuccugccgaguuagcugucaagcuguucgccgaacagagugggcggcuccgaaacaaaggaggugauuauacacauaccuuuaaucgccuugaccugcaaaaggaguugcaccuacuguucgaaagacagugugcacucggcaacccauuugcuuccgccgagcugcagucuaaaguggaugaacuucugaugacacagaggagcgcguugcaaggggaggccguacucaagaugcugggaaagugcaccuucgagcccuccgaauacaaagcagcuaagaauacuuauucagccgagcgguuuauuugguuaacaaaacugaacaaucuacgcauccucuacaacggcgaagacagagcucuggaugagggugaaaggaagcagcuuuuggacgagccuuauaaaaaggccaaacugaccuacaagcagguucguaguauacucaaucugccagagagcgcaguguucaaggggcuucgguacggaaaagauucugacggccugaaggccgaaaacggcgcuuugauggagaugaaagcguaucauaagauccgaacgguccucgaaaaagcagggcugaagggagagugggaaaauagaauuaggaaccccgagaucuuagaccaaauugguacugccuuuuccguguacaagaccgaugaggacaucaaagcugaacuggccgcacuacgccucccugagaacgugcuggaugcccuuuuggcuggccugaauuucgacaaguuuauacagcucucacugaaagccuuaagcaacauucugccacuuauggaacgggggaucagauaugaugaggcauguaaggaggucuacggagaccacagggcguuggcugaaaguaaaaaucagaugcuccugccgcagauucccgccaacgagauccgcaauccuguugugcuacgaacacugacucaagcacggaagguaaucaacgccauuauacguagauauggcucuccacagagggugcacaucgaaaccgcucgcgagcucgguaaguccuucaaagaucggaaggaaauugagaaaagacaggaggaaaauaggaaggagcgagaacgcgccgcagagcauuuuaaagaacuguucccccgguucacaggggagccuaagagcggcgacauccuuaaguugagacuguaccagcaacagcagggaaaaugcuuauauucgggcauaccaauugaucucgggaggcugaacgagaagggauacgucgaaaucgaccacgcccuucccuuuucucguaccugggaugacuccuucaauaacaaagugcugguuuuggguucagagaaucagaagaaacgcaaccaaacgccguacgaauaucucgacggcgcucgggauagucagagauggagggaguuucaggcgcgagugcaggggugucgguucccuuacgccaagaaacaacgcauccagacugcuaagcuggacagcaagacagaacagggauuucuagagagaaaucugaacgauaccagguauauugcacgguuccucugcggcuuuaucgagaaaucccugcaucuucaaggugccgggaagcgaagagucuucgcuucuaauggccagauuacugccuugcugcgcggauuauggggccucaaaaaggugagggaagacaacgaucgucaccacgcacuggacgcgauaguaguugccuguagcacagugucaaugcagcagaaaaucaccaaggcuaugcaacggagagagacgcuugaaaccauuaacacagagacuggggaggucaagaccaggaucccccagccaugggacuuuuuccgccaggaagugaugauccgagucuuuagugaugccccuagagaggaacuggcagagaaacuaaauucccggcccgaagcucuccaugauuucgugagcccacuguuuguuucuagggcccccaaccgcaagaugacaggacagggucacuuggagacugugaaaucagcaaagcgucugagugagaauauuagcguagucaaaaagccuuuaaccgcccucaagcugaaagacauagaaaacaucgugggcuacccagauagagagccggcucuuuaucgggcgcugcaagaaagguugcaggccuacaaggacgaucccgcaaaggcuuucgccgagccuuucuauaaaccagccaaagacgggggacagggcucccucguuaaggcugugcgcauuaucgaaaauacaaagcauggucugaaaguccgaaacgggauuaccgacacuaauggcgauauggugagagcagacguauaccagaaggccgauaaaaagggaaaacggcaauacuuuaucgugcccguuuaugcguggcaggucgagaagaacgagcuaccuacgguggacugcaaaggcuacgaaauagaugacacauaugaguucuguuuuucucuguacaaguaugauaucauugaaauccagaauccagacaacaugucgaaggagcuuaggguguacuauauuaauugcgauagcuccgacgggcgcuucuggcucgcucaccaugauaaaucagccaaggaacaacaguuuagaaucaguacccagaaccagcccauaauuaaaaaguaccaagucgacccgcugggaaaagagaucagguuguguaaggcagagaagcggacugaacugaauggcaaaaagaaaaaguga

SEQ ID NO: 2681 - RNA, 3210 nt, Artificial Sequence
  Cas9 variant
augaacuacgacaucggccugagaauugggauaaccagcugcggaugguccaucauuaauaaggaucucgagaggaucgaagaccuuggugugcgggucuucgagaaagccgaaaaccccgauggcacagcuucugcagccccucgccgagaggcgcguaagucaagaaggaaacaccggcgcaagaaacauagaauugaaaggaucaagcggcugauaguucagcacgacuuguuaaguaagaaagagcuggauagccuauaucucuccccauuuaauaucgacguguggaaccugcgcguagaggcucuugaacgaaagcuggauaauagagaguucgccaggguguugauucaucucguccaacggcguggguuucagacuauccgcaaaucuguggaaauucaggaggagggaaagcugcuggaaaacguuucggagaaugaaagaaucaugaaagugaacggcuacaagacggucggugagauguucucaaagcacgaaaaauuuacccaucacaagaggaauaaagacgggagcuauacaagugugguaacucggucccucuuacugaaggagauaaaaaccauuuucaacucucagcgaauccuuggaaauguuuuuagcacacaaaaguuggaguccgauuaccuguauauuuggggcucacagcgcccgacccuaacuuacgaacagcucaugaguauggugggcaacuguaucuaugagaaaaaggaaaagagagcacccaaaacaagcugggccuuccaguacuuuucucugcuucaaaagaucaauaaacugaaggucuccgacgauaacaccuugaggaaacucucaaaggaggaacgggacauugugauagagcuggcuuucaagaaaaagaaugugagcuuugucgauauccgcaaagcauuaaagcugaacgacaacacgaaauucaaucaccucacuuacagucauguuguggagaccaagaagguagaaaaagccacauuuauugagcuuaagggguaucaccugaucaaaaagcaguugaaagacagaaacguggaacuaacucaggagcugcagccuaaggauuacgacgcuauagccgcggcaucuaccuucuucaagaaugauauugaauuuagggacuaucuccguaaccaauaccuggauuccaauggaaaacgaaagagcaacaucgccaauaaagucuucgaggacaaggugaucgcugccguuuuugagcuuaacuucucgaaagugugccaucugucuuuuaaguccuuguauaaacucauuccacaccuggaaaaggguuuagauuacaaggaggcaauccugugugcuggcuauaauuuccgggacgaaaacaaaagagauaagaaacuauuucuccccgucauucagcaggagacaaauccugugguacacagggcccugacccaagcgcgcaagguuauaaacgccaucauucgggaguacgggucaccaaauacgaucagauucguggucgcaaacgaccuugcuaaaacuuacaagcagaggaaggaauuggagaguacacugaaaaagaaucgcgccgaaaacgagaaaaucaagaccaaacuccugagcaugggaauuauaaaccccacuggcauggauaucgugaaguauaaacuuugguacgaacaguccgguauuugccuguauacagggcgacagauggaguugucuagccucuuuaagccuggauacucaaucgucaaucauauuaucccauauaaccggaguuucgacgacaccuaccacaaucgugugcugacguuaaccgagacaaaguaugaaaaaggcaacaagauaccguuugaguacuucggcgcugaagagacuuguuggaaugaauacgagaaaagaguuuccaccagcaagaagauccaugauaaaaagagggagaaacugcuaauucgcaacuuugacaucgaauaugagaaugaaaugauuucuaacaauguguucgauacacacuacaucgggucauauuucgagaaguacauagacgaacaucuccaauuuaaaaagaguacuaaaaagcagaagguauucagcauucacggaaacauggucgcccaccuucauucccggugggguuuuaauaaaaacucuagagagaucuaucuuaaucacgcaguggaugccgcuauuguugcgguguugaccgaccagcugaucaggaacauagcagauuacuaucgacgcgacaauauccucgagcagaagggcucgcugaaauuccccgaaccuuggaaguccuuuuccauugaguuagaagcccggaucucaccacaagucagagaucugauuaaaaagcugaacuuggacaguuaccucgauguggacauccugcauauaaagcccguauucauuucuaaaaagccuaggcguaaagugaacggggaggcucacaagagcacaauccgcucccuaaucggaauuaaugagaucggcaaaaccguuacuugcauuaagacgcggcuggaagauauaccauuugacgagaacggugacuuccccauguacgggaaggauacagacaaauauaccuacacugccaucaaggaaagauaucucgaguuuaauaaagauaaggaaaaagcauucucaaccccgcuguacaaacuuaagaggaacggcgagccuggaaaucagauuaagagcgucaagaucauugacacacgaaacaucgugaauaaagugaaccagggcaaggggauagccuauaauucuaacaucauucgggucgauguuuuuagccgcgaccagaaauacuauguggugcccaucuacuugagagauuucauuaagggaagucugccaaauaagaucauaaccgcugccaaagguuuuaugcaauggccugagacugacaacagcuacacauucuuauucucuauuuuucccaaugaucucaucaagguagucccaaaagaaggcaaguucaucaaagcaaagaacgagaauaaagaaaacauuaaccugacggagauacuuggguauuuuaagggacuggacuccucaaccggcgcguucacuuuggaaagucacgaugguagccuccuggcuagggggaucggcacaaagaaucuacugcucauugagaaauaccagguggacguucugggacgguauaacaaggugggcaaugaggaacgacaggauaucaaaauucagcaaaacuga

SEQ ID NO: 2682 - RNA, 3210 nt, Artificial Sequence
  Cas9 variant
augaacuacgacaucggccugagaauugggauaaccagcugcggaugguccaucauuaauaaggaucucgagaggaucgaagaccuuggugugcgggucuucgagaaagccgaaaaccccgauggcacagcuucugcagccccucgccgagaggcgcguaagucaagaaggaaacaccggcgcaagaaacauagaauugaaaggaucaagcggcugauaguucagcacgacuuguuaaguaagaaagagcuggauagccuauaucucuccccauuuaauaucgacguguggaaccugcaaguagaggcucuugaacgcaagcuggauaaucgagaguucgccagaguguugauucaucucguccagaggcggggguuucagacuauccguaaaucuguggaaauucaggaggagggaaagcugcuggaaaacguuucggagaaugaacgcaucaugaaagugaacggcuacaagacggucggugagauguucucaaagcacgaaaaauuuacccaucacaagagaaauaaagacgggagcuauacaagugugguaacuaggucccucuuacugaaggagauaaaaaccauuuucaacucucaacggauccuuggaaauguuuuuagcacacagaaguuggaguccgauuaccuguauauuuggggcucacagcgaccgacccuaacuuacgaacagcucaugaguauggugggcaacuguaucuaugagaaaaaggaaaagcgcgcacccaaaacaagcugggccuuccaauacuuuucucugcuucagaagaucaauaaacugaaggucuccgacgauaacaccuugagaaaacucucaaaggaggaaagggacauugugauagagcuggcuuucaagaaaaagaaugugagcuuugucgauauccggaaagcauuaaagcugaacgacaacacgaaauucaaucaccucacuuacagucauguuguggagaccaagaagguagaaaaagccacauuuauugagcuuaagggguaucaccugaucaaaaagcaguugaaagaccgcaacguggaacuaacucaggagcugcaaccuaaggauuacgacgcuauagccgcggcaucuaccuucuucaagaaugauauugaauuuagagacuaucucaggaaccaguaccuggauuccaauggaaaacguaagagcaacaucgccaauaaagucuucgaggacaaggugaucgcugccguuuuugagcuuaacuucucgaaagugugccaucugucuuuuaaguccuuguauaaacucauuccacaccuggaaaaggguuuagauuacaaggaggcaauccugugugcuggcuauaauuuccgggacgaaaacaaacgagauaagaaacuauuucuccccgucauucagcaagagacaaauccugugguacacagagcccugacccaggcgaggaagguuauaaacgccaucauucgcgaguacgggucaccaaauacgauccgguucguggucgcaaacgaccuugcuaaaacuuacaagcagagaaaggaauuggagaguacacugaaaaagaauagggccgaaaacgagaaaaucaagaccaaacuccugagcaugggaauuauaaaccccacuggcauggauaucgugaaguauaaacuuugguacgaacaguccgguauuugccuguauacagggcgccaaauggaguugucuagccucuuuaagccuggauacucaaucgucaaucauauuaucccauauaaccgaaguuucgacgacaccuaccacaaucgggugcugacguuaaccgagacaaaguaugaaaaaggcaacaagauaccguuugaguacuucggcgcugaagagacuuguuggaaugaauacgagaaacguguuuccaccagcaagaagauccaugauaaaaagagagagaaacugcuaauuaggaacuuugacaucgaauaugagaaugaaaugauuucuaacaauguguucgauacacacuacaucgggucauauuucgagaaguacauagacgaacaucuccaguuuaaaaagaguacuaaaaagcagaagguauucagcauucacggaaacauggucgcccaccuucauucccgcugggguuuuaauaaaaacucucgggagaucuaucuuaaucacgcaguggaugccgcuauuguugcgguguugaccgaccagcugaucagaaacauagcagauuacuauaggcgagacaauauccucgagcaaaagggcucgcugaaauuccccgaaccuuggaaguccuuuuccauugaguuagaagcccgcaucucaccacagguccgggaucugauuaaaaagcugaacuuggacaguuaccucgauguggacauccugcauauaaagcccguauucauuucuaaaaagccuagaaggaaagugaacggggaggcucacaagagcacaauccguucccuaaucggaauuaaugagaucggcaaaaccguuacuugcauuaagacgcgccuggaagauauaccauuugacgagaacggugacuuccccauguacgggaaggauacagacaaauauaccuacacugccaucaaggaacgguaucucgaguuuaauaaagauaaggaaaaagcauucucaaccccgcuguacaaacuuaagagaaacggcgagccuggaaaucagauuaagagcgucaagaucauugacacaaggaacaucgugaauaaagugaaccagggcaaggggauagccuauaauucuaacaucauucgagucgauguuuuuagccgggaccaaaaauacuauguggugcccaucuacuugcgcgauuucauuaagggaagucugccaaauaagaucauaaccgcugccaaagguuuuaugcaguggccugagacugacaacagcuacacauucuuauucucuauuuuucccaaugaucucaucaagguagucccaaaagaaggcaaguucaucaaagcaaagaacgagaauaaagaaaacauuaaccugacggagauacuuggguauuuuaagggacuggacuccucaaccggcgcguucacuuuggaaagucacgaugguagccuccuggcuagagggaucggcacaaagaaucuacugcucauugagaaauaccagguggacguucugggaagguauaacaaggugggcaaugaggaacggcaggauaucaaaauucaacagaacuga

SEQ ID NO: 2683 - RNA, 3213 nt, Artificial Sequence
  Cas9 variant
auggccaccagacugggccucgacaucgggacaaacagcauuggauggugccuuuacgauggugacuccauaagggauaucggcgugcggauuuuccuggacgggcgcgagcccucuaaguugacugucucaggaaguggcacgccuuuagcuguuaaacgacgugaugcaagaggugccaggcggcgcagagacagguauaucgggcggcgcagcgcgaugcugcgagaacuaagaaagcacggacuccugccagcugauccgaaacaggccaaggugcuugagacccaagaccccuacgcacugaggguacgggccuuggaugaaaaacucgagccucaucagauuggccgugcucuguuucaccugaaucagcgcagaggcuucaaguccaacaggaaggcagaacgggccucuaaagcuggggaggacggaaagaucgccacagcgacuaaacucuuagaugaggaaaugcagcgacugggugcacgcacccuuggcgaguuuuuggugaagagagacucggaguucgauggggaggccggaaaaaggguccggaugcgcgcugacucaaaggccuaugacuuuuacccagauagaaggcaugugcuggacgaguuccgugcaauauggaaugcucaaaagguuuggcaccccgaacuacucacagagcaggccuggaacgauaucuuucgggugauugaauaucagcgagagcugaaaccucaggucgugggccauuguaccuucgcggguaucaaugggguaccagccgacgaaaagagacuucccaaagcacacccucuguuucaacagaggcgcuuguacgaggagguuaaccagcucaagguggucgcuccaggagaagccggccggccgcugacuagagaugagagggacgcuuuaauucugaaacuccaggauaagaaaagcgugaguuucgaaacacuuggcaagacccugaaguugaaagacggggagcgcuuuaauaaggaauccgagaaccgaaaagcccuagauggagacgaggugcgggcagcccugucugguaagaaacucuucggcacgcguugguuucacuucagcgcugaagaacaauggaugaucauagaaagacugcuugaggaagaggauuccgagacucuguugaccuggcucaagauuggguauaggcuggacgacgaagcggcauuagccgucgcuaaugccaagcugcccgagggacauggccgcuucggucuaucagcaacaacugcccuccugaaagaacuuaaggcugauguuugcaccuacgccgaggcagcgaaacgggcuggguuucaccauagugacuucagaacaggcgagguguuugaucaguugccuuacuauggagaaauccuggccagggagauugcaccaggcaagcccgaauacggggacgagaacgaacgacgcuucggaaaaaucaccaauccuacgguacacaucggucucaaccagcugacuaagcuggugaaugccauuauacggcugcacggcaagccagauuauaucuuugucgaguuggcuagagagcucaaacugaacgaaaaggagaaaauugccuacaauaggcaauuaaaggaaaacacagacgcagcucgugaucgcggggccaaacugggaaccaugggcgugcgggacacugguagaaacaggcuaauccuccgacuguggacagagcuuaaucccggggaugcguugaaccggcgcuguccguucugcggcgaacagauaagccagagaaugauucagaauggagagguugagaucgaacauaucauuccuuauucucaauguuuugacgauggcaucgggaacaaggugcugucccacgucaggugcaaucggcagaagggagaccagacccccugggagcgauggggucaugauccagacagauggucaauuauacaggaacaaguggcccaccuccaucgcagcaaacaguggagguucggcccugacgcucgugaucgguacgcagccgaggaagacaguuuucugcccagacaguuaaucgauacgcaguaucugaccaggauugcugccaaguaccuugcauguuuguacccagagcgcggggagcgacacguauucgcgguucacggaggcaugacagccaugcucagacggcugugggaccuaaacucuauccugcucgaucauaauuggguggaaaaccuuaauuccaacgcucccaaaaauaggcuugaccaccgccaucacgccaucgaugcagcugucguggguauuaugacuccuggguugauagccgagaucgcaaaggccgcugcgcgugccgaaaaacaaaaccuggacagauuauuugaggagcucccaaugccgugggcacagcaccccaaugaucggagguuccgcgacgaacugcgagagaagauucuugcugccaccgucagccauaaagccgaucacggcagacagggaaagccugaacggggcagggacaucacagcugggaagcugcauaacgauacugcauauggauuuaccggcuugacaucggacaccggucucccagugguugugcaccgcguaccccugacuucucuaacgccuaaagacauugccgauccagacagaauccccgauacaacccugagggggucccucuggcaggcgacucgggaccugucaggaaaggaguucgaaaaagcucuuuuggauuucagucguacccaugcccaauuuaagggcauacgccgagucagagugagggagggucugacauuaaucccgauucggaaucacgcaggcaaaccuuacaagggguaucucggagacagcaacgcccgcuacaacguuuggcagaugccagauggcagaugggugcaccaggucaucuccaccuucgaccugcaucaacccggguuuauugagcagaggccucaccccgcugcaaagaaagugcuuucucugcggcagaaugaucuaaucgccauagaacgagacggagcgcucagacagauuaugcgcguacaaaaguauggccagaacggucagaucuuccugauugagcauaaugaagcugggaacauggccgagaggaauaaaaacacugaugacccauuuaaguucuacggaccuggcgcaagcgccuugcggaauaugaaagcucgucaggugagaaucgacgaacuggguaggauauuugaucccggcccacgcuga

SEQ ID NO: 2684 - RNA, 3213 nt, Artificial Sequence
  Cas9 variant
auggccaaggacuucgaguacauccugggccucgaucuuggggaaaccagcauuggaugguccguggucagacugaacgaggguguucccgaacacuuggagagguuaggcgugcggauaugcucugacgggcgcgaugcucagucacaugaaccucugaguguagcacgacguaucgccagaggacuaaggcggcgcagagacagguauauucaccggcgcauccgacucacagaugugcuggucaaauacggccuuaugccagaggacauuaaggagaggaaaaagcugcaagcguugaauccguauagacuccggagcgaagcucuggaucguaaacuggagcccuacgaacucggucgcguguuauuucauaucaaccagagaaggggguucaaguccaauaugaagacugaccggaaagauucugagucgggagccaugaagcaggcaauacugaaaacgcgagccaagauggaggcuucaggcgcacgcacccuuggcgaauuuuuguauuuccugaacaaagacaagacaagcacucaggaguacguuccugugagaaugaggagucacuccgaaaagaauaaaaccgucuaugagauguacccagaucgggccauguacgaagacgaggugcauaagaucuuugagcaacaggaacuaucucccgaggcucagacagaaauuuucaacaccaucuuuuuccagcgcccucucaaaccaguagagcugggguuuugugaguucgaagauggagagagaagggccuauacugcgagcguuguguuucaaaaguuccgugcacuucagcagauuaaucagaucuacguccaagacgacuaugaacggcgaccccugacaaaagaggaaaaggauauauugaaacacuuucuccuggaggacuucuccgccuuagauaagaacggucugcucaccugggcuaaggugagaacgcuucugaaauugcagaagaaaaaguucaaucuagaaucagagaggcgcaaaggccugaacgccgacgugaccaguuggaagcucagcaaugcagcuugcuuugggcgggagugguucucuuuuuccgaugccaagaaagaagagauugucgcgcugaucacuggagccgaaaaggaggaggaacuuauugcagagcugaaaacaaaguacggcuugucagacgaaagagcuaaaaacacugccaauguuagccucccugaugguguggcuagucugucugccaaggcaaugaagaaauuaaucccauuccuggaggaagggaugcuauaugacgaugccguaaagcaggcuggauacguguuuuccagcucguucaaaggcguccucccggagaaguaugagaccuuuaucgaacccgagucuggcgaauguuucgacgagcugccuuacuacgggcaagugcuuaggcgcuauguuuugggaggugugccauccgaagagaacaaacuguuucccgagaaguacuauggcaagauuaauaacccuacaguccacauagugcucaaccagcugcgaaaacuuaucaauucacugguagcgaaguacgggcauccacggaaaauuguuguggaaauggcacgugauuugaagcucaguaaaaagcagaaagacgccaucgcuaaggagcaggcccugaacgaaagagagaauaagaggauaggagcagaauuagagcgccuggacauucggaacaauuaugauaacagaaugaaauacaagcuaugggaggaccucagcaccgaucccacgaaaagguccugcccguucuguggcaagcaaaucucucagcaggacaucuuuagcccugaguucgaaauugaacaccugauccccuuuucacgaaguuucauggauggucgcuccaauaaaguccuuagcugccggagauguaacagggagaaggggaauaagacuccauucgaggccuuuggcaacgacucuacacguuggaaugcuauuaugggacgcguggaaucauugccugagaacaaacgguggaaguucgccagugaugcaaugagcagauuugaaagggacggcgaucugcucgcgcgaaugaugaccgacacucaguauauggcucggauagcccgcagauaccugugcugugcagccaaucccaaccaagucuacgggaucccaggacaguuaacagcuaaacugagggagcauuggggucuuaauuccauuuugucugaucagaaggaaaaagaccggucggaucaccgacaccaugccaucgacgcauucgugguugcuugcaccgacagaggcacgcuccagaaguauagcaccgagcgcagggauuacgccaagcccgagaugccuuccgaaaaagcgccacacaucccguuugccgacuuccgucugucagauauuaagcggguguuugacgagauaaucguaagucauaaacccgauagagggaacgcuagggcagccauucuaaagggaggcacagucgcuaaacugcacgaagagacuuauuacgguaugggaggcgaaggaucuaagaagggcaccuggaaacucauccaacgcauuccugugagcgagaucaagaaagccuccgaccuggauugucuuauagaccagaaggggacagcaaacccauugcgaguucuguuagugggagcgucagagagcgaacaggagcagaucauugccucuuauuucgcuagacgggguacucauaaagucaggaccuaccgcgaacguaauaaggaugugauccuccccuuuaaagacaaggauggcaagcuguauagauacgccguauacggguccaacgcauaugcugagauuuacugcccugaccgggggaaaaaugccggcaaguggcaaguggaaaucauaccaaacuauugcgcacaccagaaagguuucauucccaaguggaggcacacagaugcccaugcuaaacuuaucaugcgccuguaccgaaaugacaugguugcguaugagaaggaggggaagaccgucauugccagagugaaaaagaugggcggaaacggcgugaucgucuuucggaaucacuugauagcaaaagaagagggggacaggcucaguuggcaggcuguugugagcggaaugcaaucugccaaccugcgcaagaucuacguggauguacuaggcagagucauugacccgaaaaggccuaugacucagaaugaaacggauggucaggacaacuga

SEQ ID NO: 2685 - RNA, 3213 nt, Artificial Sequence
  Cas9 variant
augagccacuucagacugaagcagcucaacuacauccuuggccuggacuuggggauugccuccgugggaugggcugucguugagauagauaccgaagagaaucccacaagguuaaucgacguggguguacggacuuuugaacgcgcagaggugccuaaaacgggcgauucucuggccgcggcucgacgucaagccagaucagcaaggcggcuaauucgcagaaggacccaucggcuccugcgcgcccgaagacuucugaagagggaagggaucuugcacgcugacgaucucaacgcagagggacuggucaaagagcugccaaauacaccguggcagcuccggguggacggcuuagaucguaagcugaugcccaaagaaugggccgcuguucuuuugcaucuggugaagcaccgcgguuaucuaagucagagaaagaacgagagcgaaggggccgacaaagagcucggaaggcugcuugcgggcguccaugagaaucaccaggcacugcaauccucugaauaccggacuccugccgaguuggcugugaagaaauuccaggcccagucgggccacauucgaaaccagcgcggggauuauacccauacauuugacagaaaggaucuccaacaggaacugcaccaguuauucgcagcucagcaaaaauacggaaauccauuuguaucagacggucugaagcagggcaucgagacccuccuuaugcagcaaaggcccgcccugagcggggaugcgguucagaagauguugggacggugcacuuucgaaacagaggaguuuaaagccgcaaagcauaccuauagugcugaacgcuucauauggcuaacgaaacugaacaaucucagaauccaggagaacggcaaugaaaggugucugacugcccaggagcguggucaaauuaucgaccuuccuuacaagaaagcuaagcugaccuaugcccaggugcggaaagaauugucccucccagagaacgcauuuuucaaggggcugcgauacggaaaggagaaugccgaaacagcugcguuaauggagaugaaagcauaccacgccauuagaaaggcucuggaaaaagccggccuaaagacugaguggcagggccucgcaugcaaacccgaacugcuugacgccaucgggaccgucuuuucuuuguauaagacagaugaggacauaagcaccaggcugcagggacaacucuccgaggaugugauuaacgcucugcuugccggucugaauuucgacaaguuuauccaguugucacucaaagcacugaguaagauuuuaccucugauggaacagggccagcgcuacgaugaggcgcacgcugcccuauaugugcggagcacgccacaaccgcagagacuccugccccagaucacugcagacgaaaucuguaacccugucguucuuaggacauugucucaggcccgcaaagugauuaacgcuauaguacgacgguacggguccccagcccguauccauauugagaccggaagagaggugggcaagucauucaaagauaggcaagaaauccagaagcgccaggaggacaaucacaaggaacggaaacaagcagcugagaaguuccuggaauauuuucccaacuucgucggucagccuaaagccaaggauauacucaaacugagauuauaccagcaucagcacgggcaaugccuguauagcggcaagacucuugacauuuguagguugaaugagaagggauacgcggagaucgaucaugcccucccauuuagucgaacaugggacgacucuuucaacaauaaagugcugguucuagcuggcgaaaaccagaauaaggggaaccagacccccuacgaguggcugggaggugcauccaauagcccgcgcuggcaggaauuuguggcccgggucggcucgucuagauuccaccacuccaaaaagcaaaggauccuccugcgucagcuugaugaggaaggguuuaaagagcgcaacuugaaugacacgcgguauguggcuagauuccugugcaaguuuauugaggaaaacauguuacuccugggaaggggcaaacgacggguauucgccucaaauggucagaucaccaguuuucuucgcagcagaugggggcugaggaagguucgggaggaaaacgaucgacaucacgcauuggacgcgguggucguggccuguuccacagucgcuauucagcaaagaauaacuuacuucgugcgccagagggagaugaauaucuuugauggcgaacucauugacaaggagaccucugagguuagccguccuuauuucccccagccaugggauuucuuucggcaagaagugaugaugagaguauucggaaaaccugacggcgaucccucauuuccagaggccgacacaaaggaaacucugugcacccuacuggagacaaggcucaguucccgcccccaggcaguccaugaguacgugaccccucuguucguuagccgagcuccaacuagaaaaaugucugggcagggacacaaggaaacggugaaaucagccaaacuuuugcacgaggguaagaguguccugcgggugccguuaacacagcucaaacccaaccugcuugaaaagaugguaaacagggaucgcgagccucaacuguaugaagcacuaaaagagcgucucgccgcuuacggcaaugacccagcgaaggccuuugcaaccgaguucagaaagaagggagggcagcuggugaaggcuguucgggucgaagauacucagaaaagcggcguguugcugcauaaggguaccgggguggccgacaacgccacaauggucaggguugacguguuugagaaauccggcaaguauuacuuagugcccaucuacucuuggcagguagcucaaggaauccucccuaauaaagcagucauucagggcaaggaugaaaagaacugggacgagauggaugaaaccuauacuuucaaauuuucgauguacccaaaugaccugguggagauaaacacagggaagcagcgccuuuucggauauuacaucggccuggaucgagccacgggugcgauuagcaucagagagcacgacuuggauaauuuuaaagggaagaacggaauuuaucggguuggcgugaaaaccgcuaucuccuucaagaaauaccagacugacgaacucgguaaggucgugguucccuguaggccgaagaaacgccugccugugagauga

SEQ ID NO: 2686 - RNA, 3216 nt, Artificial Sequence
  Cas9 variant
augagacugggccucgacaucgggaccaacagcauuggaugguggcuuuaccagacagaugacgguacuauaacggaugugcuggacggcggggucaggaucuucuccgauggacgggacccccaaucuaaggagucauuggccguugaucgccgaguggcucgugcacagagaaggcggcgcgacagauauuuaaggcggaaagccgcgcugaugaagcgcauggcuggcgccggucuaaugccuaccgaucaggcacacgccaaaaagcucgaaagucuggacccauacgcucuuagagcagaggggcuggauugcgaauugccgcucacacaucugggacgagcccuguuucaccucaaucagaggcggggcuucaaaagcaaccguaagacugaccgcggcgauaaugaguccgggaagauuaaagacgcuaccgccagauuagacugggcgaugagggaugcaaaggcccggacauauggagaauuucugcauacccgacaacagaaagcugacgaucccaagcgcaugccuacuguaagaacaaggcuuaccguggcccggcgcgacaacgcagagaaagaggaagcugguuacgauuucuauccagacagaaggcacuugucugaggaauuugaugcccugugggcggcccaggcagacuaccaugaggcucuaucggaugaccuccgugaucagaucaagacgauuaucuuccaccaacggccccugaagacuccugaggucggccuuugucuguuuaccgacgaacgaagaauaccaucagcccaccccuugaaucagaggcgcauccuccuggagacagugaacgcuuuacggauuguugccagaggggaagcagccaggcgccugacucucgaggaacgagaccagaucgugcaugcucuugauaauaaaaaccacaccaagacacugagcggaauggcgaugaaauugaaggcacuaggcaaagucauucggcugcguagugaccagaccuucacgcucgagacugccaauagagaugcuaucgccugcgaccuggugagggcaucccuuucucauccugaucgcaugggugggguauggacaacccuggacgagggagcccaaugggaaguugugcagcggauaagagcuguccagagcgauuccgaguuugacgccuuggugguguggcucgaacaaaaccacggccuggauaaugcacacgcgcaggcuacugccaacgcaccauuaccggagggcuaugggaggaugggacugauggccacacgacgcauucuagcugcccuccagucagacgucaugcccuacagugaugcaguugcugccugugguuggagccauucuggcgggccuaccggagaagugcuggagaaguugccauacuauggcaaaaucuuggaccggcacguaauucccgguacguacgaugagaauaacgaagacgugaagagauaugggaggaucaccaauccuacaguccauaucggccugaaccagauucgucgccucgugaaccggauaaucugcauucacggaaagccagacgagaucguuguggaacuggcgagagaucuuaaaaauuccgaggaccaaaagagggaaauacagaaaauuaucaagaaaaacacugaugccgcuaucaagcgaggcgagaagcugauuaaugaguuggggcagaaagacaccggagcaaaccggcucguccugcgcuuaugggaagaucugggucaugacgugaugacaagaaauugucccuacucaggcaagaggaucagcgccgggaugcuauucgauggaaguugcgacguagaucacauucucccguauucucggacucuggacgauggcauagcuaacaaaacccuuuguuugaaggaggccaaucgacagaaauccaacaauacaccuugggaaguuuggggugagaccgagcaaugggacacuaucgcagcgaaccugaagaaucuccccgauaacaaggccuggagauuugcuagcgacgccaugcagcgcuucgaaggggagaaugacuuuucggcaagggcucugaaagauacgcaguacuuaucucguauugcccgggcauaucuggacgcccuuuacgauggcggagacggcaacucccacgugugggucgugccagggagauugacagaaaugcucaggcgccauuggggacugaauggucuagaggcucugaccgauucagacgaaaacacugucaaggcgaaaaaccgaauggaucacagacaucacgccaucgacgcagcugugguugccgccaccgaucggggccucauccagaggauuaguaagauagcuaaacgcgacgagcaagcaggggccgaggaaguggcgcguagcguauccccucccugggauggauucagagacgacaucgcugcccagcugucucggauuaucgucagccacagggcagaucauggccgcauugacucacaggccaagcagcaaggugaggaugcuacagcagggcagcuucacauggacaccgccuacggcgugguugaugcgggacgaguggucaguagaaagccauugcuguccuuaagcgaaucugacaucaaaaagauacgggaucccgaccuccagaggcaucugacucgcgugacaaaaggccuugauaagaaagaguucgaacacgcucugucagacuuugccaaugcaagaaaguugccugaucaaagugagaacccauauuucgggaugaggcggguacgucucaucgacgcccugcaggauagcgcucgcguguccguucgagacagagacggacauauuuacaaagccuauaaggcaggcucuaaucacugcuacgaggucuggaggcuaccggaugguaagaucaaacccugggcuauuucgacguuugaagcccaccagaccgggacugagagcaagccucauccagcggccaaacggcugcuccgcguguucaagagagacaugguggcaaucgaaagggauggagagacacugauguguuauguccagaaaauggacauagcuaacggccuuuuucuuguuccccacaccgaagguaaugccgaugcucggaaccgagacaaggaugacuccuucaaguuuauucaaaugucagcagugagucugaucagagccaaaauucgcaggauccauguggaugagaugggccgguuacgugaccaggggccuccaagauga

SEQ ID NO: 2687 - RNA, 3216 nt, Artificial Sequence
  Cas9 variant
augagauacaccaucggccuggacauugggauagccagcgugggaugggcugucaucaacgaggauaaguccaggauugaagaccucgguguucggguguucaaaaaggcagaggaacccgauggcaaaucucuuaaucuggcccgccgagaggcgcgugggucaagaaggcggauccgcagaagggcuacacggaugcagaagguaaaagaauuguuagugaaguauaaccuggucagugagaaggagcuagaaacucucuacauuaucacggagaccacaccugacguguaugaacugcgcgccaaaggacuugaucgacuguugagcagacaagaguuugcaaggguucucacuaauauagccaagcggcguggcuacaaauccaaccgcaagaucgacgaggaagauaaagagguggguaagcugucuaaggggaccauugaaaauaaaagaauccugcaggagaagggauauaggacaauuggcgaaauguucuacaaagacgagaaguuugaguauaacaaacggaauaaggcuggcgaauacaacucgaccguccuccgaucaauguuaaucgaugaggugcacacucuguucgaaaugcagcgcaaauuuaagagcgaguucgcaaaugaagaguuugagaaggaauacguagagguuaugacauaucagaaaccauacauaaccccggaacuuuuggagaagaugcuggggaaaugcacguucgaaaagggagagcccagagccccuaaaaacaguuauacuuuugagagguucaugcuacuccaaaaggugaauaaccugaauauuuacaucaacggugaaaaggucgagauuccacaggagaaaaagaaagaaaucaucgagcuugcuuauaagcaguccgaaauuaaauacacccagcugcggaagaaguuggagcuccccauagaagcccgcuuugcggaccugaauuaucaaaucaaaagaacagaggaugaaucugaggaggcauuagugaagaaaauugaagacaagaaauucgugaagcuggagggcuggcauaagaucaggcucgcccuuaaagaaaacaaggauaaauuugagaagauagagaaaaacccugaacugcagaauauuaucgcugacgccuugguccguaacaagacugacgagaccaucaaaaauuaccuagaaaagagcgauauugacgaggaaaucauuaacgcaauacugaauaucaacuucacaaaguucgggcaccucuccuacaaagcuaugaauaagauuaucccagagcuggaaaaaggacuuaccuaugauaaggccugugagaacguuggcuacgaguuuaaaggucggaagaaugaacugcaguauaaguugcccccugugacggagcucgaagacgagauccugaacucaguaguguuacgagcggucagucagacuagaaaagugauuaaugccauaaucgauaaguacgggagcccaacagcaauuuauaucgagaccgcuagggaacugucuaaaccguacgacgagcgcaugaagauugaaaaacggcaaaaggagaacgccgcuaauaacgaucagaucaaggaauauauaaaagagacuuucggauuugaccccaagccuuucgauaucguuaaaaugaagcuauggagagagcagaauggcaaaugcgccuacuccucaaagccaauucccgcagaaaggcucuacgaggaaaacuuugugcaagucgaccauaucauuccuuucagccgcuguuuugaugacaguuaucagaacaaggugcugguacuuacagacgagaaucagaaaaagaaagaacgaaccccauucgaguacuuuggcgaggauaaggaacgguggcaccaguucgaggaauuuguuaacuugacguauaaauucaauacccguaagaaagagaaccugcucaucaagaauuuuaacgaagagaagucuaaagaguggauacaaagaaauauuaacgacacaaaguacaucuccaaauucauguauaauuacauugccaacaaucugaaguucgcugauagcgaaucgaaaaggaagguguauaacaucaaugggcaggcgacuucuauacuucgccauuacuggggacugaagaaagaccgggaggaauccgauaagcaccacgcacaggacgccgucaucauugcuugcgccaccaacaaaaauaucaagaaagugucagauuacaguagaaggaaguugcucuauaagaacaacgagauuaucgacgaggaaacaggugagauaauugauaaaaaguacaauaucgacaucagcauuaaagaacccuggccgaaguuucgagaggaagucgaggcacgcauggaggaugccgacaacaauggccagcuguaugcuuuaaucaacgggaauuucacuaacuacgaugacguggacauuacccauauaaaaccuaucuuuacaucccggaugcccgaaagaaagauuaccggaagggcccacaaggauacuaugcguucucaaaaauucauccagcagggccagaauuuuacgguugugaagaaaccacugaaggcaauuagcaaacaagagaucgaagguauaaucaacaauccugacuucaagaaccuauaucucucagauaagaaacuguacgacgauauuuaucagaagaugaaagaggcggacuuuaaggcugaaaaagccuucgcaaaugaguaccgcaaguacaguaaaaacggcaauucccccaucguacggagcauuaaggucgccucugcuggggccacaggagugcagcuuaagaacggcgcaaucgcugagaaugccaacaugguuagaguggaugucuuugaaaaagacaacaagaauuauuuggugccaauauacguaucagauuucgcgaaaaacgagcugcccaauaaggccauuugugcuaacaaagacgaaaaggaguggaucgaaaugaccgagaaguauaaauuuaaguucagucucuacccuaaugaucuggugaaaaucaagaggaaaaacgagaaggaauuuuaugcauacuauugcagcacucaucgagggaccggaaauauuaacuuacugcuuguuaauggugaggcccggaaggacggcgucgggaucaaaaacacagaaauauucgagaaguaccagguggauguguugggaaauauuuccaaagucaacaaggagaaacgcgaaggcguuaaguga

SEQ ID NO: 2688 - RNA, 3216 nt, Artificial Sequence
  Cas9 variant
auggacuacagaaucggccuggauauugggaccaacagcauaggaugguccaucauugagcucacaacugugcagucuaaacuugacgguaaauauaggcugaaggccgucggcuugaucgaugcugggguucggauguucgaccgcgcagaagugcccaaaacgggagccucauuagcgcugccucgacgucuagcuagaaguagcaggcggcgccucaccagaagguccgcccggaagaaagcaauucgcaaucugcuuguaaaggaggauauccugaaccaaauagaauuggaccaccucuaccgaacaucugagcugguggauaucuggcagauuagagucgaaggccuggagaggcggcucggucgucaggagugggcccgcuuacugauccaucuugggcagaagagaggauauaggucgacucggaaagcugaagagggcgcagacaccgaaggccgagccguguugucaagcauuaaggagaaucaagagacacugaaacaguaccgcaccguuggggaaaugugggcuacugaugacaaguuuaaaggaagagugaggaacaguacaaaugaguucaucuuuaacgucucccgggauaaucuagaagaggaaauacgcuuccucuuucagcagcaaagagagcuggguucuauguaugccagcaaacuucuggaggaauccuacauggagguguggggccaccaguugccauucgcgucaggggaaaguauucucaagaacguaggaaccugcagccuguaugagaaggaaaagagggcagccaaagcuacguacacuuuucaguacuucauggccuuagacaagcugaauaacguucguauccucccgucuaugcggacccuuuccgaggaggaacgaggccuggcauugaaagcuauguuugagagagauaagcuacccaaaaauccuccaaaguucacauauucacaucugaggaaggccauuaaacucgaagaggacgaaacuuuucagaccaucagcuacgacguggagaagacacuggcgaccaacgagagugccgucuucgugaaucuugcagcuuauuaccaaaucaaaaaggugugugaugaacacaacgagaauuaugacuacgucgauuauaacacgauuggucaugcccugacuguuuacaaaacagacgaagauauaaacaaguacuuggcuucuaagaauaacaucgccaaacgcguguaugcaaaugacuuuauugauuccguacucaagcacagcuacaccacuuucgggcaccugucguuaaaagcccugucucggaucauaccccuaauggaggagggagaaguguucgcuaaggcgaaagagaaggcaggcuuuaaggaagaguccuaucucgaaauuaaaucaaagcugcuuacaaacaucccugacgccaucaaaaauccagucgugaugagaaguuugacccaggcuaggaagguuauuaacgccaucauuaaacgcaugggcgagcagcccgcaagcauacaaaucgagcuggcccgagaacucuccaaggaugugucugagcggaagaaaauuacgaauggguucgcugaaaaccguagcagaaaucaguuugccaucaagacccuggaggaaaaccauaucacaaauauuaggggacaggacauagucaaauucaaacuuuggcaggagcaagguggccgcugcgcauacucacugaagccuaucaaguuggaggaacucauuaguuuucugaaaaaggagcggagauaugaacacaacuuagauguggaccauaucauuccauacuccaagacuuucgacgauagcuauaccaauaaaguacugguguuuucugacgagaacaggaagaaaggggaucagaucccggcggaauaccuaggaauaggcacaaagcgaugggagaaauacaaggaguucguuaucacuucaaaguuucccgcuaguaaaaagaaacgccuccugaaggaacagcuugucgagcgggaagaguuguucaugaaagagagacaccugaaugacaccagguaugccagccguuacuuuaugaacuuccuccgcgaaaaccuguuacggaaggagacagugcugcacgaaacccagugggucacugcaguggccgguagaguuacgucccauauuaggaagcgacuuggguuuggcaaagaucgggaggaaacacacuugcaucacgcucucgacgccaucauuguggcauguaccgauaaguggaugaucgacugcguaacuaauuauuacaaaucucgcgagggaggcucgauaaagagaaaagagauuagguucccuagcccauggaacggguucuggcaugauguccaaaccaagcuggcucagcuaccccagccugaagugaucaaugaguccauuucaaagggaaacccagacgccguugauuauaugcuggugagucggaugccccgaaaaucuaucacaggugcggcccacaaggaaaccauaagcaaauggggcggguacgacgauaagggaaaagcucuccuggucaagaaaguggcacuuuccgaguugaaguuuaagaaugacgacuucccgauguauaacaaagaaacugauccucuguuauacgaggccaucaagaauagauacguagagucaggccgcgacgugaaaagggcuuuugccacaccccucuauaagccaagcaaaucugguaagcguaacgaaguuaagcgggucaaagugauugcagagaagaaagcgauggugagagaagucaaugggggcaucgccgagaacggaggccugguuagguccgauauuuuccuuaaggaaaagaaguacgugauggugccuguauauacguuugacaccaucaagcagcaacugcccaauaaauacgucgugagugggcgcggauaugagcaguggccagaguugacugcugaacacguuuuccaguuuagcguguaccccuaugagcucguccauguggguacaaacaagggcgauaauucuuucuacuacuuugccucccugaacauaucaaguaauguucuaaaauucagcgaauguaaccgaccuaccaaggacuauauugagaucgggcugaacucgaucauucuccuggagaaauacgaaaucgaugugcuuggaagaauuacaggccaguccaagaaggguauacggcaaucuuuuaaaaauaacaagagccagaugaaagaguga

SEQ ID NO: 2689 - RNA, 3219 nt, Artificial Sequence
  Cas9 variant
augagacugggccucgacaucgggaccaacagcgugggaugguggcuuuacaagacagauggugaggccgcuuccgcaaggauugucgaaguuauagacggcggggugcggaucuucucugauggacgcgaccccaaaucaaagacuagccuggccguagaucgacguguggcgagagcugccaggcggcgcagagacagguauuugcggcgccgagcaaguuuaaugaaacugcuagccagaacgggccucaugccugcugauccagucgaggcaaagaaacuggaaaggcuugacccguacgagcugcgguccaccgguuuggaugacgcccucccccugacacacuuugggcgugcucuguuccaucucaaucagcgcagaggauuuaagucuaacaggaagacugaucggggcgacaaugaaaacggcaaaauucgagaggccaccgcgcgcuuagaucuggagaugaugacaucgggggcaagaucauauggagaguuccuucacaugaggcggcaacgcgccagcgacccuagacaugugccaaguguuaggacccguuuguccguggcugcccgggguggccccgacgcaaaggcugaagccggguacgauuuuuauccugaccgacaccaucuggaagaggaguuccacgcgcuaugggccgcacaggcuacucaccaucaggcccucacagaugaccugagagaucuugucuuugagaaaaucuucuaccagaggccacugaaggaacccaaaauuggauugugccucuuuaccgcugaggaacgcaucgccaaggcacacccucugacgcaacggagaguguuauucgaaacuauaaaucagcugaggguaaccgccgacggccgcucuacacgaccacucacucuugaggagcgggauacccugguucaugcuuuggacaacaagaaaccgacaaagagcaugaccuccaugaauaugacgcuaaaagcgcuggcaaagcuccugaaacuucgugauggugaaagauuuacucuggagacaggggugagggaaaacaucucaugugaccccguccgcgccugcauggcucacccugcccgguucggaccacaguggaguagcuuggauugggaggcacagugggacgugauuucuagagugaggcaaguccaguccgaaggcgaguuuaucgagcucaccgacuggcugauucagggccacggguuagaugccgaccaugcuaaggccguuggaaaugcaccccugccugaagguuaugcgcgacuaggcuucucagcuacugagcgcauccucgaucagcugaaagccgaaguguguacauacagcgacgcaguagccaagugcggguggcaccauagugaucaacggaccggagcuugucuugagguguugccauacuauggcgaaguccuggacagacacgugauacccgguacguacgaugccaccgacgaugagauuacaagguaugggcguaucacuaacccgaccguucauauuggccucaaucagcugcgccggcuugugaacaagaucaucgagguccacggaaaaccugaccagauugugguagaacuggcaagagaguugaagcaaucugaaccccagaaaaaggaugcuaugaaaaggcuccgaaauacaacugccgacgcgauacggcgcuccgagcagcuggagcaguuaggccaaccaaacaccgggcacaauagaaugcugcuaaggcucugggaagaucugggaccugccaucgguccccggugcuguccauacacaggcaagaccauuagcguuacuaugguguucgacgggucgugcgacgucgaucauauccuucccuuuucucgaacguuggacgauuccuucgcuaacagaacacugugucucaaggaggcaaaccgcgaaaaaucagacaggaccccuugggaggccuggggaggcacugaucagugggacgauauagcugccaaucugaagaacuuaccagagaaaaagcguaaacgguuugguccggacgcaauggaaugguucgagggggaaaaugauuuucuggacagagcgcuuguggauacccaguauuuggccaagauuaguaggauguaccucgacacacuguucaccaagggcggacacgucugggugguucccggccgcaugacugagaugcuacgaagacauugggggcugaacgcucuccugaaugauaaagaccggggagccgugaaggcuaaaaacaggacagaccaccgccaccaugcaaucgaugccgcaguagucgccgcuacggacuaucgucuuaugcagaagaucagcagagcggccggucaaggcgaaaaugcagggcaguccgcugaguugauugcccgggauaccgacgccccuugggaacacuuuagggcugauaucgcaucucagcuggagaaaauuauagugagccaucgcgccgaccacggacgaaucgauguugagggcagaaagacuggucgggacucaacagcggggagguuacauaacgauaccgcuuacggcgugauugacgaucucacagucgccagucgcacuccacugaugucccuuaagcccagcgacaucgcaaucaccgaaagaggcaaaaauauuagggacccucagcugcaaaacgccuuguacguggcuacgaagggaaaagaggggaagauguucgaacaggcacucguagauuuugccucuaaagagggaccauaucagggcauacggcgugugcgccugguugaaacccuacagaaggcggcucgagucgagaucgguaaaacagagucagggcaaccccugaaggccuacaagggagacaguaaucacugcuaugaacucuggaaacugccggauggcaagauugugccucagguggucacuaccuacgaggcacacgccgguagcgcuccaagaccccauccugccgcaaaaaggauccuucggguuuucaagaaagacauggugaaguugacaaaggauggcgaagagauugugggguauguacaguccaugcacaucaaaaacggacuguuugucgcucaacauuuagaggccaaugcggacgcccgcaacagagauaagacugaccccuucaaauuucuccagaugggcgcagggacccuggugaagacgggacuuaggcggguucugguggaugaaauaggccgacuaagagacccagguccucccaaacucuga

SEQ ID NO: 2690 - RNA, 3225 nt, Artificial Sequence
  Cas9 variant
augcagaccaagaaccugcccuacacacucggccuugacaucgggauggccagcgugggagcugcacuguuguuaccugaucaagagaggauucuggcccuacacgucagaacuuucgacaaagcggaaacggcuaaggagggugaaucccucaauaaaauacggcgcgauucucgacugacccguagaaggauccggcgcagagcccauaggcuuguucggcuggcacgcuugaugaagcgagugggccucauugccgacgcuaacccagaggcauuugcccugccggggguaucacccuggcaccugagagcugauggacucgacagguuacuggaaccuaaagagugggccggcgugcuuuaucauuuggucaagcaccgggguuuccagaguaaucguaagagcgaggcgaaagcagaugaaaaggccgggcagaugcuguccggagugggccgcaaccaggcucuacucaaagaggccggcuacagaacaguuggggaacuggcagcuaggcaugaggacuuuaaggaggccaaacggaauaagggagguucuuauucgcacacuuucgcgcgagccgaucuuaacgcagaacugaauuugcucuuugagcgccaaagagcucugggcucaagguuagccagcgcugacuuccaggaaaacgugcgggaucugcucauggcccgcagaccaacccuuaguggggcaaaucuguugaagauggucggaaaaugcacauuugagaaguccgaagacagggcccccaaagcuggcuaccgugcggagcgguucguguggcuagguaagcugaacaaucucaaaaucguagggucuggagaugcacgaccucugaccgacgccgagcacagaauuguuaucgaccuuccauuuacucaggcuaagcugacauucaaacaggugaggaaggccuuggaacucgagacccaucaacgcuuuaaccuguuaagcuaucggcccgauccuaagggcaaagacaaggauccagaagaguccacguucuuugaagcaaaaucauuccacacucugagaaaggccuacgagggcgcugggcuaaagaaggaguggcagagggacgcccucgauccggaccgccuggaugcacuugcguaugcuuugaccuguuacaaggacgauacagaaagucgacaguggcuggucgcccagggaauagguacucccaucauugaggcagugcucgccgagagcuucgacaaauuuauccaucugucucaaaaggcucuuaaagccauucugccucacauggaagcaggccagcgguacgaugacgcugccaaguccgcgggguaugaccacucacagccagaugccggaaccggcaaacgugcuacauugcccccuccagacaaggauaccaucagaaaucccguggucuacagggcacucaaccaagcccgcaagcugguuaaugcuauaguggccgaauaugguccgccugcagcgguacauauugaguuagcccgggaccugagcaaacccaucgaugagagaagggacauugaaaaggggcagaaagaguuccaggcucuaaaggaaaaacucgccgcagcuuuugaggagacguuccaccgaaagccaaguggccuggaucuuuugaaguaccgccuguuucgggaacagcucgaccaaugcccuuauugucagaaagcccugguggucgauagauuauucgagcccggauacgcacagaucgaccaugcccugccauauucuagguccuuugaugacggcaugaacaacaaggugguugugcacgucgcuugcaaucaggauaaagggaaccguacucccuacgaguuccuugacggagcgggugacagcgaacgcuggcaacgguuuguggccuggguacagggcaauaaggcaaucagacaggcuaaaaggaaccgauugcuccggguuaauuucgggacagaugaagccaaggaguuuucgaaacgcaaccugucugacaccagauacauuuguagggaguucaagcggacuauagaaacacaguuugccuggcauuccgaugcugagggaaaugaacgaugcgugguccuaucaggccaacugaccagucuccugagagcacgcuggggucuuaucaaggugagggaggacggggauuugcaccacgcccuggacgucgcggugauugcugccgcaagccguuccuuaguuaaacggauggccgauuauucuagaaggaacgaacucgagauggugcgcaaucgauacguagacccugcuacgggcgaggucguggauguugcagcccugagacagaucgaagaccauuucccaaagccguggccccuuuuccgggaggaacuguuggcgaggcucgcuccugagccaaaacugcagcuaaccugugugagcucauaugaugaaggacugcgcgagaguauacgucccauuagagucucccgggccccuacaaggcgcggccucggggcagcccaccaggagacuauccgaagccugagagacggaucucaaucagcuaucaagaccccacuucgggauuugaaccugaaagacuuagaaaauauuguggguuuugagagggacacagcccucaucgaugcaauucgcacuagacuggaggcuuucggcggggaaggaaagaaggccuuugacgauaaacagcccccgcuuaggaagccuaguaaagacccagauaaggcgcccauaauccggagcguaaaacugcuagugacccagaaguccggcauuccuauccguggugggaucgccaacaauggcgcaaugcuccgcucugacauuuucacaaaggcuggaaaauuuuacgccguucccauauaugucgcugaugcagugcgaggcgagcugccacauagagccguggcccaagcuaagccugaauuggaguggcccaugauggacgaaucguaccaguuccuguuuagcuuacacccaaacgauuggaugaccaucaggcucaaaaaugagguccgggaaggguauuacgcgggacuggaccgcgcaacuggcaacauuucccuuuggcugcacgauagaaaccagaauguuggucagaagggguugcucacgggaaacggcaucaaaacagcccuggcuguggagaaguaccauguggaccuacuggguaaacuucacaggguacauaaagaggaacggcaaccgauucacaucaagccuggcaaacgauga

SEQ ID NO: 2691 - RNA, 3234 nt, Artificial Sequence
  Cas9 variant
augaaguacagcaucggccuggacauugggauagccuccgugggaugggcugucaucaacgaggauauugaaagaaucgaggaccucgguguuaggauuuucgauguggcagaacagcccaaaaccggcgccucucuuucaacaccucggcgccuggcgcgaaguacucguaagagauugaggcggcgcagacacaggguagagcgggugcgcaaauuuaugauccaaaagggguuacugacgcagguccagauggaacagcuauaugacuggaaagauggagaccucgauauauggcuggugcgaguuaaugcucuugagagaaagcugagcgacagggaguucgcccggaucuuggugcauuuugcaaagaaccguggcuuccaauccaaucgcaaaucugaacuccaggaggaagauaacggugccguccugucggcugugcaggagaauaagagacugauggaggaaaaaggguaccagaccauuucagagaugcucuuauaugacgaaaaguuugagggaacaaaaaggaacaagggcggcgaauacacucacguaguugcacggagcgaucugaagcgagagauccaacuuauuuucgagaaacagcgcgccuaugggcaugcuuuugccaccauggaaaaugaggacaaguucuugcagaucuggaguucccagagaccauuugcgacaaaagaugacauagcaaagaaaauuggaaacugcaccuucgaaccgaaggagaaaagggcccccaagucuacuuacacauuugaacgguuccgcgcucuggacaagcuaaauagacucaggauccugagcgguaccuccccugcccguucacuuacgcaagaggagcgggaucugauuuugaacagucucuuuagcaaaaaggaagugaaauauaaggagcugcgaaaauuacugaagcucaaugacgaacagagauucaacgagaucuucuacgauccaaaugaaaagaucgagaaaaacgagaauaggacuuuucuuucucuggaaucccaguacaagauucgcaaaauauugcaaaagaucgagggcaaaucacuaaacgacaccuaucggcccgucgaucuggacacaauugcauacgcucucacuguguucaaggaugaccaggauaucagagacuaucugcagaaccaguacguggccagcaaugggaagaaagaacuuaaccuggcgaauaggaaguauaacgaugaguugauagaggaacuccugcacuuaaguuuuaccaaauucggacaucugucucuaaaggcccuccgcaauauucugccuuuuauggagcaaggcaucccauaccaccaggcaugugaaaaagcugguuaucaguucaacaagaaggucaaucgagagaaacagaaacuuuugcccccuguuccagccaaagacaucgugaacccgguagugauucggucccugagccaaguccguaaggugaucaaugggauuauaaaaagauacggaucgcccucuuccaucuacauugaacucgcuagggagaugggccgcggcuauaaggagcggaaagaccuggaaaagcaguacaacaagaauagacagaugaacgagggggccaaaaagcacauccuugaacugaggccugaguuuggagauccacgaggucaugacaucuugaaauauaagcucuggcaggaacaagauugccgcugugcauacucauucaaaaguauucccauaaagcagcuguuugagaucggcuaugccgagguugaccacauuaucccuuacagccgguccuucgaugacucuaauaacaauaagguguuaguccuggcugcggaaaaccagaacaaacagaauagaacaccauaugagugguuugggcaugaugaaaccaaguggcaagaguucacgagccuagugacuacaaugaaaguaucaaagaaaaagaagagucuccugcuuaaaaagaacuuugacgaagaacaggcagaggaguucaggucccgucacuugaaugauacccgcuacauuacucgguacaucaaaacauucauagaggacaaccugcaguuuagaaucgaagagggaaagaaaaccuauguucacacggugaauggcgccuacaccagccucaugaggaagcgaugggguuucaacaagaaucggcaagagaacgcucugcaucacgccuuagaugcagucauuguggccgucucucugcccuuuaaacauaaggugcgcgcuuauuucaaaagaagggaagaguacgcccacaaucagcuuaagcgggaaggggaguuuuucccggaaccuuggcccggcuuuauccaugaguuggagauucgaaugaugcaggacucagaaaacaucaaacucgcaauggagagucugaaucuaaagacauaugaugagagcuucauaaaagaacugaagccaauuuuuguuuccagaaugccuaagcgcgcgaugaaaggacagauccacgaagagacucucaagagggugcguggccggaccgacgacggguacauuagaacaguaaagaaggucaaacuggaucaaauccccuucgacaagaacggagauuuuccaauguucgguaaggagacugacaugaaaaccuaugaagcuauaaagucuagguaccuugagucgggcaaagauaagaaaaaggccuuuaauacacccuuguacaagccugccaaaaacccagaaaaugcaccgaucauucgcagcaucaagauugaggaaaaagcuaaccgagugguuaugcuggacgagaagaccgccgcagauaacgcuuccaucgugagaacugaggucuuccggcacaaagaaacggggaauuauuucuuaacacccguguacguagccgacgugcucgcgaagaagguuccugauaggcugauaaccacuaaaaagccauauucagaguggcgcaaaauuaccgacgaauacgaguuucuuuucagucuguaucccaacgauuugauccgugucaagaugccuaaagagaaggaaacaaagacccauacuggagagaaacacguguggcaggaaaauuuuauguacuucaagggcgugcauucugguagcgccggggucagaaugaucgaccacaugaacuccuuugaggaugaaauuggcguucggaaacucgugguguucgagaaguaucagguagacccacugggaaggaugaauaaaguccacggcgagaagcgccaugggaucuga

SEQ ID NO: 2692 - RNA, 3234 nt, Artificial Sequence
  Cas9 variant
augaaguacagcaucggccuggacauugggauagccuccgugggaugggcugucaucaacgaggauauugaaagaaucgaggaccucgguguuaggauuuucgauguggcagaacagcccaaaaccggcgccucucuuucaacaccucggcgccuggcgcgaaguacucguaagagauugaggcggcgcagacacaggguagagcgggugcgcaaauuuaugauccaaaagggguuacugacgcagguccagauggaacagcuauaugacuggaaagauggagaccucgauauauggcuggugcgaguuaaugcucuugagagaaagcugagcgacagggaguucgcccggaucuuggugcauuuugcaaagaaccguggcuuccaauccaaucgcaaaucugaacuccaggaggaagauaacggugccguccugucggcugugcaggagaauaagagacugauggaggaaaaaggguaccagaccauuucagagaugcucuuauaugacgaaaaguuugagggaacaaaaaggaacaagggcggcgaauacacucacguaguugcacggagcgaucugaagcgagagauccaacuuauuuucgagaaacagcgcgccuaugggcaugcuuuugccaccauggaaaaugaggacaaguucuugcagaucuggaguucccagagaccauuugcgacaaaagaugacauagcaaagaaaauuggaaacugcaccuucgaaccgaaggagaaaagggcccccaagucuacuuacacauuugaacgguuccgcgcucuggacaagcuaaauagacucaggauccugagcgguaccuccccugcccguucacuuacgcaagaggagcgggaucugauuuugaacagucucuuuagcaaaaaggaagugaaauauaaggagcugcgaaaauuacugaagcucaaugacgaacagagauucaacgagaucuucuacgauccaaaugaaaagaucgagaaaaacgagaauaggacuuuucuuucucuggaaucccaguacaagauucgcaaaauauugcaaaagaucgagggcaaaucacuaaacgacaccuaucggcccgucgaucuggacacaauugcauacgcucucacuguguucaaggaugaccaggauaucagagacuaucugcagaaccaguacguggccagcaaugggaagaaagaacuuaaccuggcgaauaggaaguauaacgaugaguugauagaggaacuccugcacuuaaguuuuaccaaauucggacaucugucucuaaaggcccuccgcaauauucugccuuuuauggagcaaggcaucccauaccaccaggcaugugaaaaagcugguuaucaguucaacaagaaggucaaucgagagaaacagaaacuuuugcccccuguuccagccaaagacaucgugaacccgguagugauucggucccugagccaaguccguaaggugaucaaugggauuauaaaaagauacggaucgcccucuuccaucuacauugaacucgcuagggagaugggccgcggcuauaaggagcggaaagaccuggaaaagcaguacaacaagaauagacagaugaacgagggggccaaaaagcacauccuugaacugaggccugaguuuggagauccacgaggucaugacaucuugaaauauaagcucuggcaggaacaagauugccgcugugcauacucauucaaaaguauucccauaaagcagcuguuugagaucggcuaugccgagguugaccacauuaucccuuacagccgguccuucgaugacucuaauaacaauaagguguuaguccuggcugcggaaaaccagaacaaacagaauagaacaccauaugagugguuugggcaugaugaaaccaaguggcaagaguucacgagccuagugacuacaaugaaaguaucaaagaaaaagaagagucuccugcuuaaaaagaacuuugacgaagaacaggcagaggaguucaggucccgucacuugaaugauacccgcuacauuacucgguacaucaaaacauucauagaggacaaccugcaguuuagaauggaagagggaaagaaacaauauguucacaccgugaauggcgccuacacgagccucaugaggaagcgaugggguuucaacaagaaucggcaggagaacgaucugcaucacgcuuuagacgccgucaucguggcagucucucugcccuuuaaacauaaggugucagccuauuucaaacgcagagaagaguacgcucacaaucagcuuaagagggaaggggaguuuuucccggaaccuuggcccggcuuuauucaugaguuggagauccggaugaugcaggauagugaaaacauuaaacucgccauggagagccugaaucuaaagaccuaugacgaauccuucaucaaagagcugaagccaauauuuguuucucgaaugccuaagagagcaaugcgcggacaaauucacgaagagacacucaaaagggugcguggccggacugacgauggguacaucagaaccguaaagaaagucaagcuggaccagauucccuucgauaaaaacggagacuuuccaauguucgguaaggagacagauaugaagacuuaugaagcgaucaaaucgagguaccuugagagcggcaaggacaaaaagaaggcuuuuaauacccccuuguacaagccugccaagaacccagaaaaugcaccgauaauccgcuccauuaaaaucgaggaaaaggccaaccgagugguuaugcuggaugagaaaacagcugccgacaacgcaucaauugugagaaccgaggucuuccggcacaaggaaacugggaauuauuucuuaacgcccguguacguagcugaugugcucgccaaaaagguuccugacaggcugaucacaaccaagaaaccauauagugaguggcgcaagauaacugaugaauacgaguuucuuuucucucuguaucccaacgacuugauucgugucaaaaugccuaaggagaaaggaaccaagacacauaccggcgaaaagcacguguggcaggagaauuuuauguacuucaaaggugugcauagcggguccgcgggcgucagaaugaucgaucacaugaacucauuugaagacgagaucggaguucggaagcucgugguguucgaaaaauaucagguagacccacugggcaggaugaauaagguccacggggagaaacgccauggaauuuga

SEQ ID NO: 2693 - RNA, 3234 nt, Artificial Sequence
  Cas9 variant
augcagcaaaagccccagagauacauccugggccucgaccuugggauugccagcgugggaugggcuugcgucugggcagaugagaacgaacacccuaccggucuguuggacuguggcguuaggacauucgagcgggccgaagugccaaaaacuggggauuccuuagcgcuggcucgccgacaggcccguucuguaagaaggcuaauacggcgcagagcacauaggcuccugcggcuucgccgacuguugaagagagagggagugcuccugucagccgacuuuaaugaaaacggccuggucaggggucucccgaucgaugcuugggcauuacggguggccgggcuggaccguaaacuuaguaauaaggagugggcugccguuuugcugcaccuagugaaacaucgcggauaucucagccagagaaagaacgagacgcaauccaaggauaaagaacugggcaggcuucuggcgggcgucaaugggaaccgggaggcauugcagaaucgaucugacgaauaccgcaccgccgcugagcucgccgugaagaaauucgcagcugagaacaauggaucgcugagaaacaaggguggcgauuauucacacacauuugacaggaaagauuuacagcgggaacugcaucuccuuuucgagcgccagagagcccuggacaaucccuuuacuagcagugaaauggaggcggccguagaugaauugcuaaugaagcaaagguccgcacugcagggggaggcuguucucaagaugcugggacguugcaccuucgagccuucugaauacaaagccgcuaagaacacauauagcgccgagcgguuuguguggcuuaccaaacugaauaacuugaggauucaguacaauggcgaagagagagcacucuccgaagccgagaggcgccuguuacuggacgagccauaucagaaggcuaaacuaacuuacaagcaaguccggacaauccucgaacugcccgagucagcgguguucaaaggucuuagauacgggcacggagaagacggcuugaaggcagagaguggcacccugauggaaaugaaggccuaucacgcugugaggaaagcccucaaggaugcagggcuggagggagagugggaaaaccgcauucgaaacccugagcuucuggacgccaucgguacggcuuuuagcuuguacaaaacugaugaagacauacgggccaaucucgcagcguuccgucugucugagaacgucuuagaggcucugcuagccggccucaauuuugauaaguucguucaucugucccuuaaagcauuggccaagauccugccacucauggaacaggggaugagauaugacgaggcuuguaaggaagccuacggagaucacuauggcgcaaaagagcaggaagaccauaggcuguuacccccuuuuguggcugaugacauucgcaacccaguaguguuccggacccugacacaagccagaaagaucgucaaugagauugugaggcgauacgguucaccgcuucgcguucacaucgagacugggcgggaagugggcaagagcuucagugauagaaaagagauagaaaaacgacaggaggaaaaccguaaggagcgcgagcgggcggccgcucacuuuaaggaauuguuccccaauuuugcaggagagccuaaagcccaggacauucucaagcugagacuauaugaacagcaacauggcaaaugccuguacucugggaaggagaucgaccucaggcgacugccagaaaaaggauacgucgagauugaucacgcccuucccuucucccggaccugggacgauagcuuuaacaauaagguguugguacuggguaaggagaaccaggacaaacgcaauagaacaccuuaugaauacuuagauggcaaggggaacucgggagcuuggagggcauucgcggagcggguuucuggcugucgauuuccauaugccaaaaagcagagacuccugacccagaaacuugacgaaaagacggagcaagguuuccuggagcgcaauuugaacgauacuagguacguggcucguuuucucugccaguucaucgaagagaaaaugcaucuggaaggggccggcaagaagcgggucuuugcauccaauggacagaucacagcucuacugagaggcuucugggggcucaaaaaggugagggaggaaaacgaccgccaccaugcccuggaugcagucgugguugccuguucaagugugagcaugcagcagaaaauuacccgacacuuuagauaucgggaggagcuugaacacauagacagggagacuggagaaguaauccaugguuucccccaaccgugggaguucuuucgccaggaagucaugacacguguguucuccgaugacccuguuucugaguuggcugagaagcuggauagcagacccgaagcggugcacgaguuugucaccccauuauucgugucacgggccccucauaggaaaguaacgggccaggggcaccucgaaaccauucgcagugcaaagcgacuggacgagaagaucuccgugguuaaacuuccccugacacaacuaaagacuaaagacauagaaagaauugucggauacccaaaccgggagcccgcucucuaugaugcccuggccgcuagguuggcagccuuuaaggacgauccugcgaaggcuuucagcgagccauuuuacaaaaccggcaaggacgguaaaugcggggugcuggugaaggccguccgcguugaaaaugugcagaaaucuggcuuacucgugagaaaggaugagucaggaaaaaugcagggcguagcagacaacgccacaauggucaggguggauguuuucgggaagaauggaaagaacuaccuggugccggucuaugcuuggcaaguggaaaaaggcgagcuucccaaucgggcaguuguggccuacgcggacgaggaagauugggacgagauggaugacaguuuugaguucaaguuuagccuguauccuaacgauuugguagaagucgugacuaaaaaggacaaauucuuugguuacuauuccggguucaaucgugcuaccggagccaucaacaucaaggaacacgaccucucuaaaucgaaggugaagaauggcgucuacgaggguauuggcguuaaaacagcacagagcuuccagaaguaucagguggauacccuggggaaaacuauccgccuauguaagccagagaaacgaaugggauuuaagaagaaauga

SEQ ID NO: 2694 - RNA, 3237 nt, Artificial Sequence
  Cas9 variant
augagauacgugcugggccucgacaucgggauugccagcugcggaugggcugucauaaaccaggagaaggaaaggaucgaggaucuugguguucggauuuucgacaaagcagaaaaucccaaggauggcaaaucccuggccgcgccucgccgagacgcucguucuaccagaaggacauugcggcgcaagaaacacagaaugcaaaggaucaagguguuacugguaaagcaugggcuacucucaaaaacugagcuggaucaccuuuaugaaagugccacggagguggacgucuggaaccugcgguuggaugcacucgagcgcaagcuguacccaaaagaauuugcccgaauccugauucaucucgcuaagagaaggggauucaaaagcaaucggaaggagaccacauuauccgaaaacggccagauacuggagucuaucucggagaaucagcagauuauggaaaagcaaaacuaucguacugugggugagaugauccuuaaagacaagaaauuugaaaaucacaagcgcaacaaaaaugggaccuacguuggaacagugaccagacagcaguugcaggaugagauucaaaugaucuuccaugcacagaggcuguauaagaacgacuacgccacugaagaguuugagucaagcuaucuagaaauaugggcuagucagcggccguacgccuccaaagaucagauugagaagaugaucggcuacuguacacucgaacccaaggagaaacgagcgccuaaggcaucuuggagcuuccaauauuuugucgcccugcagaccauuaauaaccuucgccugaucuccaaagacagaaucgaagaguugucauucgaggaaaagaaacagauuaugaaucucgcucuggagaagaguauagugaaguacaucgauauuaggaaauuacugagcguaccaaacgaauuucaauucaauucucucuccuauucagccgacacgguugacacugcaguggagagccggaagugcaucgaacuuaaagaguaccacaguauaaacaaggucuauaaacagauuuacggcgagaacgcucugaauuugcuacccaaguauuacgauaccaucgccuacgggcugacaaucuuuaaggacgauaaagacauucucgaauaucugcagaacaaguacgugaaugcgaaaggaaagccuaucucuaacuucgccaauaaaacuuaugaugacaccuuuauucaggcacuucugaacuugaauuucacaaagaugggucaccucuccuucaaggcucugaaaaacauaaucccauuuuuagaggaaggccugagcuacgauaaggccugugagaaagcuggguauaauuucaagggaaccucguacacggagcaaacuaaauaucuacccgugauuccucagaacacaaauccagucguucaucgcgcccucucucagaccagaaaggugaucaacgcaaucauuaaaaaguacggcuccccgaaugccauacacaucgaaacugcuagggagcugucaaagacauuucaggaacguaaagagauugacaguauguaccaagauaacagcaagaaaaaugaacaugcgauccacaaacuuaaggaguuggguaacauuaaccccuccgggaucaauauaguaaaguucaagcuguggaacgagcaggacggacggugcauguauucuggcaaauacaucgaaccucaccgacucuuugaggaaggcuauaccgagguggaucauauucugccauacagcagaucacuugacgacaguuauaauaacaagacgcugaccuuggggacagaaaaucagaggaaaggaaacaagauccccuacgaguauauggguaauacuuccauuuggaacgauuucgagacccgcguccagagcaauaaaaagaucaacaagaaaaagcaacagaaacuccuguuacagcacuuuucuuacgcacgggaacaggaguucauagaaagaaaucugaacgacacaagguacgccacuauuuaucuaucaagucucauccaacagcaucugauuuuuagcgaguccucucgcaagaaaaaggugcacaccguuucgggcaucauaacaagccaucuucgaucccgguggggguucaauaaggaucguaaagaaggacacauccaccaugcuuuggacgccgugauugucgcagugaccucagaucacaugauccagagaguaacuaaguacuauaaacugaaggagcucaacaggaaucugcaagccaaacgcaugccuuuuccagagcccugggaaggcuuccgguuagagcuggaagcuagaauuaguccgaacacgcagcaguaccuuaaggguuugagguuuaaaaacuaugccgacguuaaucucucugagaucaagagcauauucgugucccgaaugccuaagcauucaauuacaggggagcugcaccaggaaaccauccgcaaauucaucggcuacaacgagaagggaaaaguccuaacugcaauuaagaccaaacuggaagauauccccuuugacgcgaauggcgauuucccaauguaugggaaggagagcgaccucuacacauacaacgcuauuaaggaacgguaucugucucacaaaaaggauaaaagaaaguccuuucaagagccucuuuacaaacccaccaagaguggagguauaggcccauugaucaagagcauuaaaaucauggacacuaggacaauugugaaucccgucaaccaggggaagggagugguuuauaauucuaaaaucgcccguacggauguguucaagaaagaggaaaaguacuaucugauaccuaucuacaccauugacuuaaugaagaacauccucccacagaaagcaauuacugccggcaaggguuaugaggacuggacaaccaucgauccguccuuuacauuccuguuuucacuuuuccccaaugaccugauacagauuguaccuaguaaaaacaagacuaucaaagcucgcaccacggucagcaagaaggaaguguugcucccaucgcugaccggguacuuuaaaggcguucauuccggaacagccggcaucacuguggagacccacgaugggucugucauugcaaaugugggaagcaagcaacuacugcucauagaaaaauaccagguagacgugcuggguaacuauacaaagaucaaagaggagaagcggauuggccuuacuaccuacaaugauaacaaaaagaucgcugccuguuga

SEQ ID NO: 2695 - RNA, 3237 nt, Artificial Sequence
  Cas9 variant
augaagcagcaaccccagagauacauccugggccuggaccuugggauugccagcgugggaugggcucugauauuggucgaugaggaagguaacccuaucggcuuacuggacugcgggguuaggaccuucgagcgggcagaagugccaaaaacaggagauucccuagcccucgcgcgccgacaggcucguucuguaagaaggcugauucggcgcagagcccacaggcuucugcgguugcgccgacuccugaagagagagggcgugcugucagcagccgacuuuaauagugauggucucccgaacuuacccaucgacacuuggcagcugagggucgcugggcuugaacggaaauugacgaaucaagagugggcagccgugcugcuacaucucguuaagcaccguggauaucugagccagcgcaaauccgagacccagacagaaaacaaggagcuuggcugucuguuggcuucuguggccaaaaauucgaaacuccugucagaaaacgcgaaucaguacagaacuccugcagaguuagccgucaggcuguucgcugagcaaagcggccaucuccggaacaaagggggagauuauacccacacauuuaaucgacuugaccugcagaaggaauugcaucuacuguucgagcagcagcgcaccuuugguaacccauucgccagugcagaacuccaauccaagguggauggccugcuuaugaugcagagaucugcucugcagggggaggccguauugaaaaugcucggaaagugcacuuuugaacccagcgaguacaaggcggccaaacacacauauuccgcagagagguucauuuggcugaccaaguuaaauaaccugcggauccuagaaaauggcacggagcgcgcucucaacgaagccgagagaaaacugcuuuuggacgaaccuuacaagaaagcuaagcugacuuauucacaagccaggaaacuccuggauaugagucacgacgcaaccuuuaagggucuucguuacgggaaggauagcgagggacugaaugccgagaacggcgcuuugauggaaaugaaagcguaccauaagauacggacaguucucgacaaagcaggccugaagggggagugggaaaaccgaaucagaaauccagagauuuuagacaaaaucggaacugccuucucucuguauaagaccgaugaagacauucaggcugcccuagcagaucucaggcugcccgagaacgugcuuaaugccuugcuggcuggucucaacuuugacaaguucauccagcuguccuuaaaagcccugucaaauauaaugccucuuauggagcgcggcauucgguacgaugaagcauguaaggaggucuauggggaccacagagcguuggcugaaagcaaaaaccagaugcuccugccaccgauccccgccaaugagauuaggaacccuguggugcuacgcacacugacccaaacgcgaaaggucaucaaugcaaucauucggcguuacggaaguccacagagaguucauauagagacugccagggaacucggcaaaucuuuuaaggaucgcaaggagaucgaaaaacggcaggaggaaaacagaaaggagagggagcgagcugccgaacacuucaaagagcuguucccccacuuugcuggugaaccuaaagggggcgacauucuuaaguugcgccuguaugagcagcaacagggaaagugcuuauacuccagcaucccaauagaucucggccggcugaaugaaaagggguauguggagauugaccaugcacuucccuucucgagaacaugggaugacucuuuuaacaauaaaguacugguguugggauccgagaaccagaagaaaaggaaucagaccccguacgaauaccucgacggugccucaaacagucaacguuggcgcgaguuccaggcgcggcugcagggcuguagauuuagcuaugccaagaaacagaggauccaaacugcuaagcuagauuccaaaacagaacagggguuccuggagcgaaaccucaaugacacccgguacaucgcacgcuuucugugcggauucauugaagagaaccuucacuugcagggcgaggguaagagaagggucuuugccucuaaugggcaaaucacggcucuguuacggggccucuggggacugaagaaagugcgagaagagaacgauagacaucacgcccuugacgcaauuguuguggcguguagcaccgucucaaugcagcagaagauaacaaaagccaugcagcgcagggaaacucuggagaccguggauacagagacuggcgaaguaaagacccguaucccucaacccugggacuucuuucggcaggagguuaugaugagaguguucagugauacaccacaugaggaacuagcugaaaaacucuccgggaggccugaggcccugcacgacuuugucagccccuuguucgugucucgcgcaccaaaucgaaagaugaccggacagggucaccuggagacugucaagucagcuaaaagauuaagugaaaacauuagcgugguucggaagccccucacggcccugaaacuuaaggauaucgagaauaucgugggcuauccugacagggaaccagcacuguaccaggccuugcgcgagcgucuccaggcuuauaaagaugacccgguaaaggcguucgccgaacccuuuuacaagccugcaaagaacgggggacagggcucccuggucaaggcugugagaguuaaagaugugcagaagacaggugucauggugcggaaagaccgcgggggcauugccaggggaauagccgacaaugcuaccaugguacgaguggauguuuucggcaagaaggggaaaaacuaucuagucccaguguacgcauggcaaguggccaagggaauccugcccaauagagcggucguugcuuacgccgacgaggcagauugggacgagauggaugacucuuaugaauuuaaauucacucuuuacccuaacgaucucguggagauuaucucgaagaaaggccggauuuuugguuauuacagcgggcugaauagggccaccggagcuaucgacauaaaggaacaugauuuguccaaagagaaggcaaagaacggcauccaccaaucaguggguguaaaaacaguccugaguuuccagaaguaucagguggacccauuaggcaaagaaauuugccucuguaagguugagaaacaucccgagcucaauucuaagaagaaaaaguga

SEQ ID NO: 2696 - RNA, 3237 nt, Artificial Sequence
  Cas9 variant
augggcuaccugaucgggcucgacauuggaauaaccagcguggguuaugccguccuucagacagauuucaagggcaaccccuacaaaauccuguugaugaauacuguuauuuuuccuguggcugaggcaccaaagacgggggaauccuuagccgcgccgguaagacagaaaaggucuucacggcgcaccaaccgacguacaaaguucagaaaacugagggugcaaaagcuauuuguccgguucggacuccuggagagugcugacguggccacuuuucuuaaucagaagguuccccaccaggauaucuggcaacugcgcaaagacgcauugaacagaaagcucagcaauagggaacuguucgagauucuguauuucuucgugggccaucgggguuuuaaauccaaccgccgaucugaagucaccgggaagcagccuaaagauaaucaggugguacucacaucgauccacgacagaggaaacaccuuaaaugauuucgacucacugggcgagaugaugcaggagcuuccagaauuuaagacuauaaagcauaacaaagccuacaggcccgauaauacaaucuauccuuugcgggcuuggauugagcacgaacugagcgcaaucuucaguguucaacagaagaacaaucgucagauuaccgacaacuuuaucacgcaguaccuagauauauuccgcucccaaagagacuucgaucagggcccagccgcucccucuagguuugggggaaauaugauugagcggaugguggguccugacagccucgacgcccaugagaaacgagcggcaaagcugacuaacaccuucuuucgcuucaacuuucuuuccacacugaauaacuugaaaauccagcucacucugggcgccgaauuucacccauuaaccacaccgcaaagagagauuguccugcaggcugccacccucaagucacuuaauuauaaacagaucaggcacaagcugcaguugcccgauagugcacgguuuaaccuagugccuuaccaaagcaaugaagacccaaucaagacggagucuaaacauuaccuguucaagcgcaaagcucucacucagauugaagccgugacagauaacccccagcugauagacaagaucgggaccauucuugcguauuuuaaaggagauaagacuagacaggagaagcuguccgccuugaaucucucaagggcagagaucaaacaacuguuaccuauaaaccagccaggcuucgguaaucugagccuaaagacaaugcacaaaauucuccccuaccuggaacaggggcaucuuuaucacgaggcugcccaguuggcuggauacgacuuucaaaacaaucuggucgaucgucaguaucuccgggacaaccugaagaauccgguugugaaccgagccaucggcaaaaccaucaagguagugaaugcaauuaucaagaaauacggcgauccugacgccauucacauagaacuuacgagagagaucaagcauagucacgaagagaggcagaaaauugcucgccagaugaacaccaacauggaucaaaaugacaaggucgcggagcaucugcgggaaaacgggauccccgugaauggacagaacaucauuaaaucuaaguuguucuaugagcagaaggguauagaccucuacuccggccaacagaucaaugaacaggaucuguacacagaggaccacuaucagguugaucauauuaucccauacagcauuucguuuaacgacucuuucacuaauaaaaccgugacaagaacuuccaacaaucaaaacaaggcaaauagguuaccucuggaauaucuaucagaggagaaacaggaugccuuccgcgcucgagucaugaguaacaucagcaauuaccggaagcgucagaaccuccugaaagaagggauaaccgaggacaauagacagcaauggaagacaaggaacaucaacgauaccggauauauuaaucgccuuuugucccaguaccugcggaacaaugugcaguuuacuaaaaagucucacaaccccguauucacgguuaauggcgccacaaccgcauauaucagaaagagguacgguauuaucaaaaaccgacaggccacugaccuccaccaugcuguggaugccgucauaauugggugcaucagcaauaccuuugugucacgccuggcaaaguacagugaagcgcaagaggcucgguaucacaaacaguuauggcagauuacacaauacagacaggagcauaaggaccuguccaccaucgaauaucaggagcuuauaaaacaguucccauugcccuggccugauuuuaggcacgaacucauggcccgucugagcacugacccagcaaagaugauggcccaccauacaugggagcacuacacggaugaagagaucucucaacuaaagccggcuuucgucauucgcucagccaaccauaaagugaccggcagugcacacgacgacacuaucuauagcaagaaacuguacgaucagcggggaguuggccuccugagaacaucccuucagaauuugaaguaugacucuaaaaaggaugggauuaagaacuacgagaggcugaaagacggaucgaauagcuuaguguacgauucccuccugcgagcucuuaaggaacaugacgguaacgccaaaaaggcguuucccgauaaucagcuguugaucucaaccggcaaccaccaacagauaauuacacacguaaaaacugucaagaagaucacccauccuaucgaggugaaucgggacacggccauugcuaucgggggacgcaugauuagaguugauauauucaaacaggcaaaggcccagaaacucaucggcauuccaguguaugucaacgacaccgugaagcccacacugccuaacagggcuuguaccagugguaaacgguacucugauugguaucaacuaacucgacaggaccaguuucugugcagccucguauccaaugaucuggugcuuguugaaacagccucaccauugaaggucacuaacaauaucaccaacgaggaagugcagacgacacaacuguuauguuacuucagcucuuuuaauauugcaaacgcgcagaucaauuuccacuccauaaacaaugacaguagcaucaaccccauugugcucaauaaagucaccuaucugacuaaguaccagcuugacuaucuggggaacuacuuuccgguuaagcaugagucuagaaaaacauucaaucgcaagagguga

SEQ ID NO: 2697 - RNA, 3237 nt, Artificial Sequence
  Cas9 variant
augcacaccagacuggcccucgacaucggcacaacuagcauuggguggauacuuuacgagcuggugaacggacagcccgcuuccaucuuggaugguggcacgaggauuuucucugacgggcgggaagcaaagaccggacauucauuagccgucggccgccgaacagcgcgugguaugagaaggcggcgcgauagauaucugaggcggcgcgcugcccuaaugaaacgacucgcagccaucgggcugaugccugagaguccagaagcugcagcccaacuugcuacucuggacccguacgaguugagagccaggggacucgaucacccccugccuccagaacaucugggccgggcgcucuuucacuuaaaucagcgucgcggcuucaagagcaacagaaggaccgacaaagggaauaacgagggagguaugauugcagaugccuccgcucggcuggagcaggccaugauggcagcuggcgcccgaucuuauggggaauuucuucauaagcgcagagcggaggccacagcacccagggcuaccccugccguucggacucgcaucaauccacacuugacaggagaagacggcaaagagcagcccgguuacgauuucuauccugacagaaagcaccuggaggaugaauuucauaggcuaugggaggcucaagcccgucacaacccagaccucaccccggcaaugggggaucugcuuuuccagacgauauuucaucagcggccccugaaggccccugcugugggacgaugcuuguuccucgacgaaccaagacugcccaaagcgcacccuuuaacucagcaaaggacccuguacgagacaguaaauaugcuccgcaucgcaccacccggccagccgaagcggagacuuucgagggugcagcgcgaccagauuguccacgcccugaacaaucgaaaaaucuuggcuucaccuggcaagaacgugcuaacucuggccgcaauugggaaacuccugaagcugcggcccggagaagccuuuagccuggauaccgcuaaucgugacgccaucgcaugugauccaguuagaaugaguuuggcguaugaggguagguucggcccucaaugguccgcucucucuguggagagccagugggaacugauacagcgcuuacgggacgaucaagacggggccgcacuggucgauuggauuauggacagauacggauuugauagggaccgagcccgcgcuaucgccgaugcaccccuaccagagggcuucggucggcucggggaaacagcuaccagagccgugcuggcgguacuuauuggcggaacgacugagcaggaaguuuugacauacuccgaggccguggcugcaugcggcugggaccauucaaggcuggggaccggagagguccucgaccgucugcccuauuacggucaggugcuugaucgccacgugcugccuggcacugggcggccagaagacgaugagaucacaagauuuggaaggaucaccaacccgacgguccauauuggcuugggucagguuaagcgacucgugaauaaaguaauagacgccugggggcggccccacgaaaugguggucgagcuggcucgcgauuuaaagaugagugaagaccaaaaacgcaaccuggccaaggugaaugcacagaaccagagggcggccgagaugcggagcgcuaaacuaaucggcgaucucaagauugaggacaacggacgaaauagaggcauccugcgcguuugggaagagucugccgcagaugugcuucauagguguugcccuuauaccggggcucagauauccgccucaauguuguucgacggaagcugugauauugaccacauccugccauacagucguacacucgaugacgguuucaacaaucgggucaucugccugaaaucugcaaacagagaaaagaggaauuuaacucccugggaggccuggggcaacaccccuaagugggcugcgauugaggccaaucugaaaaaccuuccacccgcaaaggcuuggcgcuuugccccggacgccauguugcgauaugaaggggagagagauuucacagcucgggcacucguggacacucaauaccuguccaggcuagcccgcgaauaucuggagugucucuacgcggaagauaucgacccuggaccacacagcggcaaaaagccccguagaccuauuuggguaguuaccgguaaacugacagagcuuuugcggaggcauugggggcuuaauucguuacuccccgaugcucaccgcggcaccgccaaggcaaagaaccgacuggaccauagacaccacaugauagaugccgcuguggucggagcaacugaccaugccacggugcagcggaucgcgaauauggcuaaaggcaacgucgagaaugggcuugaagaucuggccggaacaauuuugccaccuuggcccggccucagggacgaucugaaggcacgccuagagagaaccaucgugucucacagggguaaccauggggccaucgacccagcugcccggaaacagggacgugauacuaccuccggccagcugcacaaugacacagcauacggucucaccggcgaaacucugaaggggguuccgcuugugguaaaccgcaaaccuauugacauguugacacccgcuaugauagauaagauccgagacccacaucugucaagaugguuaacggccgucaccaagggaaaagagggcaaggauuuuaaagcggccguggaagcauucagggcucaccccgggccuuaucggggaauuagaagaguuaggcucaucgagccaguggaggucauucggaucaaggaccgaaacggcagacccuacaaagguuauaagggggauaguaaucaaugcuacgaaguguggugucugccugaccgcacucuuacacaccauguagugagcaccuuugccgcucaccagggacagacaggcaagccgcauccagcagccaaaaggcuggcccggcuauauaagggugauaugguucgucucgacagauccaaauucggcucugucauagcuacuguggagaaguuugauaggaacgggcagcuggaauuggugccccacaaugagggaaacgcggaccaacgcuaccggaaagauaagagcgacucagucuucauccgacugagagcagccaccuuuauugcuaguggcgccaggcgcguuaucguggacgaaauggggcggauuagagauccuggaccaggcaaacauuga

SEQ ID NO: 2698 - RNA, 3240 nt, Artificial Sequence
  Cas9 variant
augaaguacggcaucgggcuggacugcggaauuaacagcguggguuauuguauaauggagcucaauuccgaugacgaacccaaaagaaucgucaggcuuaacucucggauuuucaccgaggccgaaaauccuaaggauggcucaagucuggcugcaccacgccgagaggcccguggguugagaaggcggauccgcagacacaaacauagguuagaacggauucgcgcgcugcuaguucgagagaacaucgugacacaggcugagcucgacaauauguuuagcggaacucuguccgauauauacgaacuuagaacggccgcacuggacgccccguugaacaauaucgaguucgcuaggguacucauuaaccuggcacaacggcguggcuuuaagucuaaucgcaaaucggaaaagucaagcagugauaaggagaccgguaaacugcucuccgccaucaagaaaaacaaggagucuauugaagcugggggauauagaacagugggcgagauguuauucaaagacgaaagguacgccaagcacaagcggaauaaaggcgaggcguaucugaacacugucagccgagauaugaucgaagcagagauacaugccguguuugcuucccagcgcaauuucgggaugcccuuugccaacgagaagauugaaaaugaguacaccgacaucgcacuuucacagagaccuuucgauuugggaccaggugaaggccccgagaacugcaaaaguccuuaugcugggaagcagauuaaaaacaugaucggacaauguacauuuuucccagaagagaagagggccguuaaagcgagcuacucuuuucagcuguucucccuacuccagggcaucaauaacauuacccuggugucaagcgacgguaauacuuuuccccuuagucaggagcaacggaagacacugaaggauuacugcuucaaaaccgccaacgucacguaugcaucuauacgcaagguguugcagaucccucaggaauacacuuucaaaaauauuaccuauacagacgacgggaucgagaaguccgagaaaaagacuaaguuucagcaccucaaaccauaccaugagaugaagaaaguacugggaagcgcuauacaaaccuuaacaccggaagaacuggaugagauuggcgaaaucuucaccuuuuauaaggacgagacgaucauuaucaaacagcucgaagagacugagauugauaagucgcuuuacgaccuguugcuacagcugcccacauucgaaaaggccggccacauaucuaccaaggcuuguaaaaugaucauuccuuuucucgaggaagggaaaacuuaugauaaggccugcgagugugcaggacugaacuucaaagcccacacaaauaugcaaaagcagaugcuucugccagcuaaguccgacgaauugaacgauguugugaaucccgucgugagaagggcgaucucacagaccaucaaaguggucaacgcaauuauacgugagauggguacgaguccuaccuacaucaauauugagcucgcccgggaacugagcaaguccaaaaaggagcgagacgaaaucaacaaaaaguacaaauuaaaucaggcugagaacgaaagacugaagaaugagauuaucgauaacuuuaagauaaaaccaaacggccaagacaucauuaagcuaaaacucuggcaugagcaggaugacgggaucugccccuauacaggaguuaggauuaaguacgaaaaucuguucgacgauggcuaugccgagaucgaccacauaauuccguacucucuuagcuuugaugacucauucaacaauaaaaucuugacuaccgcaacacagaaccgccagaaggguaaucggauuccucuggaauaucuccccgagagugaaaaggauggguuuagaguguggguaaacuccaauaucaggaaccaucgcaaacgacaaaaucugcuuaaggagcacuucacugaggccgacaaaaaggaauuuaaaagccggaaccugaaugauacccguuacuugaacaagcuccuguuaaauuauauaaacgacaaucugcuauucacagauuucuacaacggcaagaaaaagcacgugaccucugucaacggagcugugacugccuacaucagaaaaagguggggcauuaauaagaaccgcgaggacggggaucuccaucacgcaguugacgcggcugugaucgccugugucacgcagggaauuaucaaucggauaacagcauauucagccagaaacgaagcuccauacgaucugaauaccgagacuggugagauuaaagaaagguuuccucuucccuauccaaacuucaagaaggaguuggacgcccgaaccacaaucgaagacgagaaacgccugaagcgggugcucaugaguuuuagcaauuacuccuaugaugacguagaaaaagcaaagcccugcuucguuucuagaaccccucauaggaaagugacuggcgcugcccacgaggagacaauccguucggggaaggucgaaggauuuacggugagcaaaaccgagcugacuaaguuaaagcugacaaacggcgaaauugaggguuacuaugaaccagaguccgauacccuuuuguacaaugcgcuccugcagcgccuaaacgaguucgggggcgacgccaaagcugcauuugccgaugaguuccauaagccgaaagcugacggaacacccggcccugucgugaagaaaguuaagacuaucaagcggucaaguucuaaugugaaagccagaaacaagaaugggcugggaguagcagauaacgguagcaugauuaggauagacgucuuuuacguggaaaaugaaggcuauuacuucguuccaaucuauguggcggauaccgucaaagagaugcccaacgaagccuguccuuuugggaaggacaaaaagaagauuaugacggaugacgauuuccucuuuucccuguacccaaacgaccuuaucaaaauuaccgcuaagaaagacaugaaguucucauuggccaauaaagagagcggacugcccaagaacaaguaugcaaaugagguguuaguauacuauucugcugccgauaucuccaacgcaaguauaagcgugaucaugcacgacaaugccuacaaauuccgaggcugcgguauuaagucucucguuaaacuggaaaaguacacagucgauccgcuugggaacguguccaaagugaaucgggagaagcgcauguauuuuaaguga

SEQ ID NO: 2699 - RNA, 3240 nt, Artificial Sequence
  Cas9 variant
augagacugggccucgacaucgggaccagcuccauuggaugguggcuuuacgagacagauggugccggcucugacgcuaggauaacugggguggucgauggaggcguucggaucuucucagacggucgcgaucccaagaguggggcaagccuggccguggaccgacgugcggcuagagccaugaggcggcgcagagauagguauuugcggcgccgagcaacguuaaugaaaguacuggccgaaaccggacuaaugccugcugacccagcagaggccaaggcucucgaagcccuggauccguuugcgcuuagagcagccggccuggacgagcccuugccucucccacaccugggcagggcucuguuccaucucaaccagcggcguggguuuaaauccaaucgcaagacagauagaggagacaacgaaucugguaaaauuaaggaugccacugcaagguuagacauggagaugauggcuaauggcgcccggaccuacggggaguuccugcacaagcgacgccaaaaagcgacagaccccagacaugugccuucggucaggacccggcuuucaaucgccaaccgcggaggcccagaugguaaggaagaggcaggguaugacuuuuaccccgauagaaggcacuuggaagaggaguuccauaaacugugggcugcccagggagcucaccacccugaacuaacugagacacuccgugaccugcuuuuugaaaagauuuucuuucagcggccacugaaagagccggaagugggcuugugccucuucagcggccaucacgggguucccccuaaggauccacgacugcccaaggcccauccuuuaacccagagaagggugcuguaugagacggucaaucaacuccgcgugacugcagacggacgggaggccagaccacuuaccagggaggaacgcgaucagguaauccacgcucuggacaacaaaaagcccacaaaaaguuuguccucuaugguucuaaagcugccggcgcucgcaaaagugcugaagcugcgagauggugaacgguuuacucuggagaccggcguccgugacgccauagcuugugauccuuugagagccagccccgcacacccagacagguucgggccucgcugguccauccucgacgccgaugcucagugggaagugauuucacggaucagaagggugcagagugacgccgagcaugcagcgcuggucgauugguuaacagaggcucacggacuggaccgagcccaugcagaagccaccgcucacgcaccccuaccagauggcuacggucgccucgggcugacggccacuacacggauucuuuaucaauugaccgcugacguugugacuuacgccgaugcgguaaaagccugcggcuggcaucacagcgacggaagaacaggcgaguguuuugauaggcugcccuacuauggggaagugcucgagcgucacgucaucccuggaucuuaccauccagacgaugacgauauaacccgcuucggucggauuacgaauccgaccgugcacaucggccugaaccagcuuagaaggcugguuaaucgaauuaucgaaacacaugggaagccccaccagaucguggucgaguuggcucgggaccucaagaaauccgaggaacagaagcgcgcagacauuaaaagaauaagggauacuaccgaggccgcuaagaaacggucagaaaagcuggaggaguuagaaaucgaggacaacggacgaaauagaaugcugcuacgccucugggaagaucugaacccugacgaugccaugaggcguuucugcccauauacaggcacucggauuagcgcagcgaugaucuuugacgguaguugugauguggaccacauacuucccuacucuagaaccuuggaugacuccuucccuaauaggacacugugccuccgcgaggccaaccgacaaaagagaaaucagaccccauggcaggcuuggggcgauacuccccauuggcacgccauugcagcuaaccugaaaaacuuaccggaaaauaagcgguggagguuugccccugacgcaaugacgcgcuucgagggggagaacggauuucuggaucgugcccuuaaagacacacaauauuuggcuagaaucagccggucguaccucgacacccuguucacuaagggcgggcauguauggguugugccaggaagguuuaccgaaaugcuacgccgacacuggggucuuaauucucuccuguccgaugcgggcagaggggccgucaaagcaaagaaccggacagaccauaggcaccacgcuaucgaugccgccgugauugcugcaaccgaccccggacuuuugaaucgcaucucaagagccgcgggccagggugaggcugccgggcagagugcagaacugauugccagggauacuccucccccaugggagggcuuccgggacgauuuacguguccgccucgaccgaauaaucgugagccauagagcugaucacggaaggauugaccaugcagcccggaagcagggccgcgauuccacagcggggcaacugcaccaggaaacggcuuauucuaucguugacgacauccauguggccagcagaaccgaucuucugucauugaaaccugcacagcuccuggacgagcccggaaggaguggccagguacgggauccacaacuacgaaaggcccugagagucgcuacuggugggaaaacaggaaaggacuuugagaacgcccuccgcuacuucgcauccaaaccgggcccuuaccaggcuauuaggcgggugcguauaaucaagccccugcaggcccaggcgagaguuccagugcccgcccaagauccuauuaaggcauaucaggguggcagcaaucaccuuuuugaaaucuggagguugccagacggggagauugaagcucaggucaucaccucuuucgaggcccacacacuggaaggagagaaacgcccccauccugcugcaaagcgguuacuccgagugcacaaaggcgauaugguagcccuggagagagacgggaggcgcgugguuggacauguccagaagauggauauagccaacggccuuuuuaucgugccgcacaaugaagcuaacgcggacacucggaauaacgauaaaucagacccauucaaguggauucaaaucggugcaagacccgccauugcuagugggauccguagggugagcgucgaugagauaggacggcugcgcgacggcgguacccgaccuauuuga

SEQ ID NO: 2700 - RNA, 3240 nt, Artificial Sequence
  Cas9 variant
auggacgaggaagccaagauccagcugagcaaagaguccuacgaagaggaacucgagucucuucuggagaagucaggcgaagaguucagagauguguuuuugcaagcuaaaaaggucuaugacgcaauuuuacugagugauauacuaagcaccaaaaagcagaacuccaaggccaaacucucucuggggaugaucgaaagguacgacucgcacaagaaagaucuugaggagcugaagcaguucguuaaagcgaauuugcccgaaaagacagcuauuuucuucaaggacucaagcaaaaacggauaugccgguuacaucgauggcaagacuacgcaggaggacuuuuauaaauuccucaagaaagaacugaaugggauugcaggaagugagcgguuuauggaaaagguggaucaagagaacuuccugcucaaacagcgcaccacagccaauggcguaaucccucaucaggugcacuuaacugagcugaaggcuauaaucgaacgacagaagccauacuauccguuucuugaggaagcacgugacaaaaugauuagauugcugaccuucaggauccccuacuacgucgguccucuagcccaaggggaggaaacauccucuuuugcuuggcucgagcggaagaccccagagaaagugacucccuggaacgccacagaaguuauugauuauagcgcguccgcaaugaaguucauccagcgcaugauaaauuacgacaccuaucugccuacggagaaagugcuuccaaagcauucaauucuguaccagaaguauacuaucuuuaacgaauugaccaaagucgccuacaaggaugagagaggaauuaaacaccaguucaguagcaaggaaaagagggagaucuucaaggagcucuuucaaaagcagcggaaagugacaguaaagaaacugcagcaauucuuaucugcuaauuauaacaucgaagacgccgagauucugggcguugacaaggcauuuaauuccucauacgcuacuuaccaugauuuccucgaccuugccaaacccaacaccgaacgcguggcggagcuguuggagcagccugaaaugaaugccauguuugaggauauagucaagauccuaacaauuuucgaagaccgagagaugaucagaacccagcugaagaaauaucagagcgugcucggcgauggguuuuucaagaaacuggugaagaaacacuacacgggaugggguaggcuuagugaacggcugauaaacggcauucgugacaagaaaacuaauaagacaaucuuggauuaucucaucgacgaugacgauuuuccauacaaccgcaacagaaauuucaugcaacugauuaacgacgacucuuuauccuuuaaggaggagcuggcaaaugaacuagcucucgccgggaaccagagccugcuugaggucguugaggcuuugccgggaucgcccgccaucaaaaagggcauuuggcagacccugaaaauaguggaagaacucaucgagauuaucgguuauaauccuaagaacaucguaguggagauggcaagggaaaaucagcggacuaaccgaucuaaaccacgccugaaggcccuugaggaagcucugaaguccuucgauucacccuugcucaaagagcaaccugucgacaaucaggcgcugcagaaggauagauuauaccuguauuaccuacagaacgggaaagacauguacacaggagaagcacucgauauugacaggcugagugaguaugauauagaccacaucauuccacggagcuuuaucguggauaauuccauugacaacaagguucuugugucuagcaaagagaaucgcuugaagauggaugacguccccgaucaaaaggugguaaucagaaugaggcguuacugggaaaaacugcuccgggccaaccugauaucagagcgaaaguucgcuuauuuaaccaaacuggaacuuacgccggaggacaaggccagauucauccagaggcaguugguugagacccgccagauuacaaaacauguggcagccauccucgaccaauacuuuaaucagccugaagagaguaagaacaagggcauucggaucauaacucugaaauccagccuagucucucaguucagaaagaccuuuggcauucacaaagugagggaaaucaacaaucaucaccacgcucaugaugccuaucugaacggggucguggcaauugcgcuccugaagaaauaccccaaacuugagccagaauuuguuuauggaaauuacacaaaauuuaacuuggcuacugagaauaaggccaccgcaaagaaagaguucuacucaaacauccugcgcuuuuucgaaaaggaggaauauaguuacgacgagaauggugaaauauuuugggauaaagcccgacacaucccucaaauuaagaaagugaucagcucccaucagguaaacauugucaagaagguggagguucagacaggcggguucuauaaagagaccgugaaucccaagggaaaaccagacaaguuaauccagcggaaagcuggcugggaugucucuaaguacgguggguuuggcucgcccgugguagccuaugcaguggcuuucauauacgaaaagggaaaagcccguaagaaagcgaaggccauugagggcaucacuaucaugaaacaaagccucuuugaacaggacccuauuggguuccuguccaacaagggauauucaaauguuacgaaguucaucaaacuuaguaaguacacacuguacgaguuggaaaacgguagaaggcgcauggucgcuucucacaaagaggcacagaaggccaauagcuuuauucucccagagaaacuggugacccuacuguucuaugcucagcauuacgaugaaauagcccacaaggaguccuuugacuaugugaacgaucaccucucagaguuccgggaaauccuggaccaagucauugauuuuagcaauagauacacuaucgcagcgaagaacaccgagaaaauugccgaacuuuucgagcagaaccaggaaucuacaguucaguccuugagucagagcuuuaucaaucugaugcaauuaaacgcuaugggcgccccggcagacuucaaguuuuucgaugugauaauccccaggaaacgauauccuucucucaccgagauuugggaauccacuaucauuuaccagucaaucacagggcugcgcgagacgcggaccagaauggcuacucuuugggacggagagcaauga

SEQ ID NO: 2701 - RNA, 3240 nt, Artificial Sequence
  Cas9 variant
auggacgaggaagccaagauccagcugagcaaagaguccuacgaagaggaacucgagucucuucuggagaagucaggcgaagaguucagagauguguuuuugcaagcuaaaaaggucuaugacgcaauuuuacugagugauauacuaagcaccaaaaagcagaacuccaaggccaaacucucucuggggaugaucgaaagguacgacucgcacaagaaagaucuugaggagcugaagcaguucguuaaagcgaauuugcccgaaaagacagcuaucuuuuucaaggacucaagcaaaaacggauaugccgguuacauugauggcaagacuacgcaggaggacuuuuauaaauuccucaagaaagaacugaaugggauugcaggaagugagcgguuuauggaaaagguggaucaagagaacuuccugcucaaacagcgcaccacagccaauggcguaaucccucaucaggugcacuuaacugagcugaaggcuauaaucgaacgacagaagccauacuauccgucccuugaggaagcacgugacaaaaugauuagauugcugaccuuuaggauccccuacuacgucgguccucuagcccaaggggaggaaacaucuagcuucgcuuggcucgagcggaagaccccagagaaagugacucccuggaacgccacagaaguuauugauuauuccgcgucagcaaugaaguuuauccagcgcaugauaaauuacgacaccuaucugccuacggagaaagugcuuccaaagcauaguauucuguaccagaaguauacuaucuucaacgaauugaccaaagucgccuacaaggaugagagaggaauuaaacaccaguuuagcucuaaggagaaaagggagaucuucaaggaacucuuccaaaagcagcggaaagugacaguaaagaaacugcagcaauuuuuauccgcuaauuauaacaucgaagacgccgagauucugggcguugacaaggcauucaauucaagcuacgcuacuuaccaugauuuucucgaccuugccaaacccaacaccgaacgcguggcggagcuguuggagcagccugaaaugaaugccauguucgaggauauagucaagauccuaacaauuuuugaagaccgagagaugaucagaacccagcugaagaaauaucagagugugcucggcgauggguucuuuaagaaacuggugaagaaacacuacacgggaugggguaggcuuucugaacggcugauaaacggcauucgugacaagaaaacuaauaagacaaucuuggauuaucucaucgacgaugacgauuucccauacaaccgcaacagaaauuuuaugcaacugauuaacgacgacuccuuaucguucaaggaggagcuggcaaaugaacuagcucucgccgggaaccagagccugcuugaggucguugaagcucuacugggaucuccggccaucaaaaagggcauuuggcagacccucaaaauaguggaggaacugaucgagauuaucgguuauaaucccaagaacaucguaguggagauggcaagggaaaaucagcggacuaaccgauccaaaccucgccuuaaggcccuggaggaggcuuugaagucauuugauaguccacuccugaaagaacaacccgucgacaaucaggcguuacagaaggauagacuguaccuauauuaccuccagaacgggaaagacauguacacaggagaagcacuggauauugacaggcuuagcgaguaugauauagaccacaucauuccucgguccuucaucguggauaauucuauugacaacaagguuuuggugagcucaaaagagaaucgccugaagauggaugacgucccagaucaaaaggugguaaucagaaugaggcguuacugggaaaaacuccugcgggccaacuuaauaagugagcgaaaguuugcuuaucugaccaaacuugaauugacgcccgaggacaaggccagauucauccagaggcagcucguugagacccgccagauuacaaaacauguggcagccauccuggaccaauacuucaaucagccggaagaguccaagaacaagggcauucggaucauaacucuaaaaagcucucuggucucacaguuuagaaagaccuucggcauuaacaaagugagggaaaucaauaaccaccaucacgcucacgaugccuaucucaauggggucguggcaauugcgcugcuuaagaaauacccuaaguuggagcccgaauuuguuuauggaaacuacacaaaauucaaucuggcuacugagaacaaggccaccgcaaagaaagaguuuuacaguaauaucuuacgcuucuuugaaaaggaggaauauagcuacgacgagaacggugaaauauucugggauaaagcccgacauaucccacaaauuaagaaagugaucuccucucaccagguaaauauugucaagaagguggagguucagacaggcggguuuuauaaagagaccgugaacccuaagggaaaacccgacaagcucauccagcggaaagcuggcugggaugucucgaaguacgguggguucggcagcccagugguagccuaugcaguggcuuuuauauacgaaaagggaaaagcccguaagaaagcgaaggccauugagggcaucacuaucaugaaacaaucccuguucgaacaggaccccauuggguuucuuucaaauaagggauauaguaacguuacgaaguucaucaaacugucuaaguacacauuguacgagcucgaaaaugguagaaggcgcauggucgcuagccauaaagaggcacagaaggccaacuccuucauucugccugagaaauuggugacccugcucuaucacgcucagcauuacgaugaaauagcccacaaggagucauuugacuaugugaaugaucaccugagcgaguuccgggaaauccuugaccaagucauugauuuuucuaacagauacacuaucgcagcgaagaacaccgagaaaauugccgaauuguucgagcagaaucaggaauccacaguucagagucugagccaaucuuuuaucaacuuaaugcagcucaaugcuaugggcgccccagcagacuucaaguuuuucgaugugauaaucccgaggaaacgauaucccucccugaccgagauuugggaaucaacuaucauuuaccagaguaucacagggcuucgcgagacgcggaccagaauggcuacucugugggacggagagcaauga

SEQ ID NO: 2702 - RNA, 3243 nt, Artificial Sequence
  Cas9 variant
augaagaccagcuucgccuuugacaucggcacaaacuccauuggguggugcgugcuggcucucgauaaugcaaaccuucccuacagaauacuggacgccggagucaggaucuucucugauggucgggagccuaaaucaggcacgaguuuggcggaagggcgccgauuagcucguggaaugagcagaaggcgggaccgcuauaagagaaggcggaaagccguuauucgcacucugaucgaguacggccuaaugccagaugacccggcagcccggagagcucucguggcagaaaccaaugauaaggcccccgguaaaauugcuuccgacguauaugcccugagggcgcgggcacuugaugacaagcugccuuugcaccauaucgggcgugcccucuuucacauaaaccagcgcagaggauucaagucuaauaggaaaacagauaagcgggacaacgaucaaggcaaaaucgcuucgggcauuucacgacugcgcgacaagcuggccagcgaggggaugagaacucucggagaauacuuaaaucauaggcaccaggcagguaacugggugcggguccgcccaaguagagugcccggcaaagacgauaaggaggaggacggguauggauuuuacccugaaagggcucugcuucaggaugaguucaaugccaucuggaccgcgcaggccgcacauuauccagacguuuugacagaagaacgucggacccaccuggagacuauuaucuuuuuccaacgaccccuaaagccugugcaggucggcaaauguuccuuuaacccaggugaagagagacucccgagggcucacccccuguuccaggaauuucgccuuuacaaggaggugaaugaacuggaguugguagaucggaaccaggaccaucacaaacucucucuggaucaaagagacgccuuaauagcucagcugaagacacagagggaggccgcauacagcgcccuccgcaaaaccgcucgagcgccucuugggacgcgguucaauaaggaaacugagucccguaccaaaaugaagggagaugaaguugcagccgagcugucagcuaagacaagauuuggccaggccuggauuaguaugccauuggaagagagguggaucauuguggacacucuacgccgggucgaggauccccuggaacucaccgcauggcuggagcaacauuauggccuugacggggaacacaucgacgccauccuggcugccagauugccugagggauacgguaggcucggcgaaacagcacugaccgagauuuuaguggagcugaaagcggcugugauaagcgaagccgaggcagcccgacgcgcuggguaugaucacgcccuacuccagcggggagcaggccuggaagcccuuccaaaguaccaggaggucaucgcuagaaggauucccccggguacggggaacccugacgaucccuaugacguugagaaaggccguaucacuaauccaacagugcauauaggauugaaccaacugcagaagguacucaacgcgcugauucgccgguacggcaaaccugaacagaucgccaucgagcuugcuagagaacugaaguugaaugaugagcagaagagggagaaaaacauugagaucgcacgaaauacccgggccgcugagcaacgcucugccaagcucguggaacuggggguccccgacacuggauauaacagaguguuacugaaacuaugggaggaacucaaucugagggcaccagagaaccggguuugcauuuacuguggugaacccauaaauaucgagacacuuuucuccucagcgguggauauugaccacaucuugccuuggagcaagacccuggaugacagucaggccaaccgacucgucugccauguggcuuguaauagacagaaagccaacuacgcaccagcugagguaccgcaguggcaaggccgcuaugaugacauccuggccagggcaaauacguuaccccugaacaagcguuggcgguucgggagagaugccaugaagaaauuugcugacgaagagaccuuccuugcgaggcaguugacagacacucaguaccucucucgccuggcccacgcauauauggcugcccuauacccugaugaggaaccagacgcccagggaguucuggcucgaaagaaucaugugagagucauuaccggccggaugacagaaaugcucaggcgccaauggggucugaacucccuuuuggcagaucacaaucagaaaaaccguaacgaccacagacaucacgccauagaugcggcuguggucggggugacuacccgggcccuguuacagaggaucgcaacaguugccggcggacgcgaggcucaggcacucgaggaaaccauuggcaagaucgagcccccuuggccaggguuucgagacgaacugcaagccgugauuaaaagaaucguagucagccauaagcccgaucacggaacucuuccgaagccuggucagggcgggcagacggcgggacaacugcacaaugacacagcuuauggcuugaccggugagacugauucgcgggggaccccaauagugguuaggcgcaaacccuucacaucucucaccgagaaggaccugccuuccaucagagauaggcagcuagcccaggcacugggcucagccauugcuggacggaguggcaaagaacuccaggccgcacuggagcaauuucgugaccgcgaugacuacaagagcauccgacaugugagagucguggaaccccuuaacguaauuccaaucagggacgggacuggacgggcuuauaaagccuacaagggcgaugcgaauuaccgcuaugacgugugggaguugccuaacgguaaauggaugcacgaaguugucuccauguucgaugcccaugacagaucuuggacaagcgcagugcacauacaucaccccgcugccaggcgggugcugucauuaaagcagaaugauauggucgcuuacgaccacccacaggaugggccgacgauuggacgaguugugaaguuuagucaguccggccaaaugaccuucgcaccucauaaagaggccggugcccucaaggcuagagacgcggaucccgaggaccgcuuuagguauuucuacaaaagcggcucugcaaugaaggauaucgggcugcgacaggugcguguagacgaaauuggaagagucuuugacccaggccccagggauaaagaggcccgcaacgcucggaagaagaaaucaacugacuga

SEQ ID NO: 2703 - RNA, 3243 nt, Artificial Sequence
  Cas9 variant
auggccaagagcuucgcuuuugacaugggcaccaacuccaucgggugggcagugcugggacucgauucugccggugaccccgauucaauugagggcgcgggggucagaauauucagugacggaagggaaccuaaaagcggcgcuucccuugccgagggucggcgcaucgcacgagggaugucucguagaagggaacgguacaaggcccgcagaaaagcucugauuaggacauugggagauuauggcuuaaugccacuggagcgggcagcccgccgagcucuaguugccgaaacuaaugacagaucguuuggccucguggcgcaggauguauacgcacugagggcccgggcucuuguggagaagcugccgcccuaucacuuggggcgugcccucuuccaucugaaccaacgcagaggauuuaaaucaaauaggaagacggacggucgggauaacgagcugggcaugaucgcaaccgggauugcugcccucgacgcgcaguuaaauggacgaacacugggccaguaccuucacgaaaugcgcggugccgauccuagacagagggggcaaguccgggugcgcccacauuuggagaucaacgacaagggaagagaaauagcagcuuauggcuucuacccccagagggccaugcuggagcgugaguuuaaugcuaucugggccgcacaggccccucaccauccagaacuacucagcgaggaacggcgagcucaccuguuccagguuaucuuuuaucaaagaccccuuaaacagccugauccagggaggugcaguuucaacccggcggagccccgccuggcaaaggcccacccuuuguuucagcgguucagacucgugaaagaaauuaaugagcugaggauugucacuggguccaacucucagggagugccauuaacccuggagcaacgcgacauccuccuuacacuguugcgagacaagaaagcuagcuccuuuaagacccuacuggccaagauaauuaaaggucagcccgaagcacgguucaauaaggccucagauagucgugacaaaaugaagggcgaugagcucgcugccacuaugagcgacaaaacaagauucgggcaggcaugguuugcgaugccugaagcugagcaauggaggaucauugccaagcugcgcgauaucgacgauccacuugaacugaacgcaugguuggagucugaguacggacucgcccccgaacggagagacgcuguagccaaugcacuguuaccgcagggcuacgguaggcugggggagaccgcucuacgaacgaugcucgauuaucuggaagccgcgguuaucuccgaggccgaagcugcagcccaggcuggcuacgaccaugcccuugcacgccggggagcgggcuuggaucagcugccuaaauaucaagaggugcucgggagaaggauucccccaggaucaggugagccuaacgaccccuacgacauacguaugggccgcaucagcaauccaacuguccacauugcccugaaccagcuucggagaguggugaacgcucugaucaggaaguaugggaagcccgccgaaauagcaauugaguuggcucgagaucucaaacugagugaagaacagaagcgggaggucaaugccaccaucgccaaaaacacacgcgacgcagaaagaagggcuguucgguuagcggaugagggaaucgacaauacuggccauaaccgagcccugcuaagauucugggaggagcucgcagcugauccucuggaccgcguguguguauacugcggugggggcauuggagccgccucucuuuuuaauggcuccguggauaucgaccacauuuugccauggagcaggacccuggaugacucgcgugcuaaccggauacucguccacaauucuuguaacagacugaagaggaauuucgcaccguuugaagugcccgaguggcgcgagaucuaucaggauauuuuaguucgagccgcgaaacugccugcuaacaaguccuggagauucgccccagacgcaauggaucgguuugaaggggagaaggacuuccuugccaggcaauugacagacacccaguaccucgcucgcauggcacaugaauaccuggccgcgcuauaucccgaugaggaaccugacgaguggggaguguuugcucgugguaaucacgucagagugguaccaggccggcugacggagaugcucaggcgcgccugggggcugaacgcaauccuuucagaugacaaucgaaagaacagaaaugaucaucggcaccaugccaucgacgcuguuguggucggagugacuacaagggauauguugaacaaaauuagucaggccgcaggccgcggugcugacaugggggccgcggaugcccugagaagguucgaucccccguggccuagcuuucaccaggcaguccgggcugccguggaacguauauuaguuucccaccgcgcugaccauggcacccucccaggaacugacggccaagggucuacagcaggacagcugcacaacgauaccgccuacggccuuacgggugagacccgaaaagggcuggccgugguagucagaaggaagcccuauuugagccucgaaccucgggacaucgagacaauucgcgacccccagcugagagaucaucuagcuacugaaaccuacggacuggcgggcgcagaguucacagccgcucucaaaaggcugcagcaaacugacaaguuuuaugccgguauccggcgagugagaguuaccgaggcacuuucagugauuccaauccgcgaugccacaggccacgcuuacaaggcguauaaaggggacgccaauuucagguacgaugucugggaauugccuaacggaaagugggugcccgagguaauaaguauguucgacgcacacgaucggggcugggugucccagguucaugcugccaauccagcagcccguagaguccugagcuuaaggcagaacgacaugguggcuuaccaacacccggaacaggggcucguguauggacgcgucguuaaauuuggccagucuggucagaugaccuucgccgcgcaucacgagggcggaucacugaagagucgggaugcagaccgagaugacccuuuuaaauacuucuauaagagcgccggcacuaugaaggacaucggucuuagacaaauuaggguggaugagaucggccgcgugcaggaccccgggccacaggaucgggacuccaaaagaguacguaagucugauagguga

SEQ ID NO: 2704 - RNA, 3246 nt, Artificial Sequence
  Cas9 variant
auggccgcuuucaagcccaacccuaucaauuacauucugggccucgacauagggaucgcaagcgugggaugggccauggucgagauugaugaagacgagaacccaaucugccuuauugaucuggguguuagaguguuugaaagggcggagguaccgaaaaccggcgacuccuuggcuauggcccggcgcuuagcacgaucugugcguagacugacaaggcggcgcgcccacagacuacucagggcucggcgccugcuuaagcgagaagggguccugcaggcagccgauuucgacgagaauggauugaucaaaucacuccccaacacuccuuggcaacugagagcugccgcgcuggauaggaagcucacgccauuagaguggagugcagugcugcuucauuugauaaaacaccggggcuaucugagccagcguaagaaugaaggugagaccgccgacaaggaacuaggggcucuccugaaaggaguugccgauaacgcacaugcccuucagacaggcgacuuucgcacucccgcuaagcuggcguugaauaaauucgagaaggaguccggccacaucagaaaccagaggggagauuacucucauaccuuuucgcggaaagaccuccaagccgaacugaauuuacuguucgagaagcagaaggaauuuggaaacccucacauuucagauggucucaaagagggcaucgaaacacuucugaugacccagcgaccagcauugagcggggacgcugugcagaagaugcuaggacacuguacuuucgagcccacagagccuaaagccgcuaagaauaccuauacggccgaacgcuuugucuggcugacuaaacucaacaaucugagaauuuuagagcaaggcagugaacagccacugaccgacacacagagggcaaaguugauggaugagccguaccggaaauccaagcucacuuaugcccaggcucgcaagcuguuaggucuggaagacaccgcguucuuuaaagggcuaagauacggaaaggauaacgcagaggccucuacacucauggagaugaaggcuuaucaugccaucagcagggcacuggaaaaagagggccuuaaagacaagaagucccccuugaaucugucaccugaacuccaagaugagauaggcaccgccuucagucuguuuaaaacggacgaagauauuacugggcgucuuaaggaccgggugcagccagagauccuggaggcuuugcucaaacacauuagcuucgauaaguucguacagaucucucugaaagccuuacgaagaaucguuccccugauggaacaaggaaagagguacaacgaggcaugcgcggaaauuuacggugaccauuauggcaagaaaaacacagaggagaagauauaccuaccuccaauccccgcugaugaaauucgcaauccggugguccuccgggcccugucccaggcaagaaaagugaucaacgggguggucaggcgcuauggaagcccugcccgaauacacauugagaccgcucgggaaguuggcaagucauuuaaagaccguaaggagaucgaaaagagacaggaggagaauaggaaagaccgcgaaaaggccgcagcuaaauuccaggaguacuuucccaacuucgugggugaaccaaagaguaaagauauccuuaaguugcggcuguaugagcaacagcacgggaaaugucucuacucuggcaaggaaauuaaucugggaagauuaaacgagaagggcuauguagagaucgaccaugcccugccuuuuuccaggacuugggaugacagcuucaauaacaaagugcuugucuuggggucggaaaaucagaacaagggaaaucagacacccuacgaguacuuuaacgguaaagauaauucucgagaauggcaagaguucaaggcgcgcguggaaaccucccgguuuccaagaaguaaaaagcagaggauucuccugcagaaguucgacgaggauggcuuuaaagagcguaaccuaaaugacacgcgcuauguuaaccgguuccugugccaguuuguggccgauagaaugaggcucaccgggaaggggaaaaagcgagucuucgcuucaaacggccaaauaacaaaucugcuucgggguuucuggggguugcgcaaagugagagcagaaaacgacaggcaccaugcccuggaugcuguaguuguggccuguagcacugucgcaaugcagcagaagaucacccgguuugugcgauacaaggagaugaaugcguucgacggcaaaacaauugauaaggaaacuggagaggucuuacaccagaaaacccauuuuccccaaccuugggaguucuuugcccaggaagugaugaucagaguuuucggcaagccagacgggaaaccggaguuugaagaggcugacacacccgaaaagcuccgcacccugcuugccgagaagcuguccucuaggccugaggcagugcacgaauauguaacuccauuguucgucagccgugcucccaaccggaaaaugucaggacagggucacauggagacggugaagagugccaaaagacucgaugaaggcguuuccgugcugagggucccucuaacacaacugaagcucaaagaccuggagaagauggugaaucgcgaacgagagccaaaacuuuacgaggcauugaaggccagacuggaagcucauaaggaugaccccgcgaaagccuuugcagagccguucuauaaguacgauaaagcugggaaccggacccagcagguaaaggccgugaggguugaacagguccagaaaacuggagugugggugcgcaaucacaacggcaucgccgacaaugcuaccaugguccguguugauguguuugagaagggugacaaguauuacuuagugccuauuuacagcuggcaaguagcaaaagggauacucccagauagagccgucguggcguaugcugacgaagaggauuggacaguuaucgacgagucuuuccgguuuaaguucgugcuguacucaaacgaucuuauuaaaguccagcugaagaaagacaguuuccuaggcuauuuuagcggacucgacagggccaccggcgcaaucucccugcgcgaacaugauuuggagaagucuaaggggaaagacggaaugcaccgaauuggcgugaagacugcccugucguuccagaaauaccaaaucgaugaaauggguaaggagauaagacccugccggcuuaaaaagaggccucccguucgcuga

SEQ ID NO: 2705 - RNA, 3246 nt, Artificial Sequence
  Cas9 variant
auggccgcuuucaagcccaacccuaucaauuacauucugggccucgacauagggaucgcaagcgugggaugggccauggucgagauugaugaagacgagaacccaaucugccuuauugaucuggguguuagaguguuugaaagggcggagguaccgaaaaccggcgacuccuuggcugccgcacggcgcuuagcccgaucugugcguagacugacaaggcggcgcgcucacagacuacucagggcacggcgccugcuuaagcgagaagggguccugcaggccgcugauuucgacgagaauggauugaucaaaucacuccccaacacuccuuggcaacugagaagugccgcgcuggauaggaagcucacgccauuagaguggagcgcagugcugcuucauuugauaaaacaccggggcuaucugucccagcguaagaaugaaggugagaccgccgacaaggaacuaggggcucuccugaaaggaguugccgauaacgcacaugcucuacagacaggcgacuuucgcacucccgccgagcuggcguugaauaaguucgagaaagaaucuggccacaucagaaacaggcggggagauuacucgcauaccuuuucacgaaaggaccuccaggccgagcuggauuuacuguucgaaaaacaaaaggaguuuggaaauccucacauuagcgacgaccucaaggaagguaucgagacacuucugaugacccagcgcccagcauugaguggcgaugcugugcagaaaaugcuagggcacuguacuuucgagcccacagaaccuaaggccgcuaaaaacaccuauacggccgagagauuugucuggcugacuaagcucaauaaccugaggauucuugaacagggauccgagcggccacugaccgacacagaacgcgcaacuuugauggaugagccguacagaaaaucuaagcucaccuaugcccaagcuaggaaacuguuagagcuggacgauacagcguucuuuaagggccuacguuacgguaaggacaaugcagaagccagcacccucauggagaugaaggcuuaucaugccaucucccgggcacuggaaaaagaggggcuuaaagauaagaaaucacccuugaaccugaguccugaacuccaggacgagauaggaacggccuucagccuguuuaagacugaugaggacauuacaggccgacuuaaggauagagugcagccagaaauccuggagguauugcucaaacacauuucuuucgacaaguucguucagaucucccugaaggcuuuaaggcgcaucgugccccugauggaacaaggcaaacgguacgacgaggccugcgcagagauuuacggggaucaugacgggaaaaagaauaccgaagagaagauauaucuaccuccaauccccgcggaugaaauuagaaacccggucgugcucagggcucugucacaggcccgcaaagugaucaacgcagucguucgacgguacgguagcccugcccguauacacauugagacugcuagagaagugggcaagaguuuuaaagacaggaaggagaucgagaaacgccaggaagagaaucggaaggauagagaaaaggccgcagcuaaauucagggaguauuuucccaacuucguaggggaaccaaagucuaaagacauccuuaaguugcgacuguacgagcaacagcacggaaaaugucucuauuccggcaaggagauuaaucugggucgcuuaaacgaaaaaggguacguggagaucgaucaugcccugccuuuuagccggacaugggacgauucguucaauaacaagguccuuguguugggcucugaaaaucagaacaagggaaaucagacccccuaugaguacuuuaacggcaaagacaauuccagagaauggcaagaguucaaggcgaggguugagacgucacguuuuccacgcaguaaaaagcagcggauucuccugcagaaauucgaugaagagggguuuaaggaaagaaaccuaaaugacaccagguacgugaaccgauuccugugccaguuugucgccgaucacaugcuccugacaggaaaggguaaacggcgcguguucgcuagcaauggccaaauaacuaaccuuuugagaggguucuggggacugaggaagguacgggcagagaacaaucgacaucacgccuuagacgcuguuguggucgccuguuccaccguggcaaugcagcagaaaaucacaagauuuguccgcuauaaggagaugaacgcguucgacggcaaaacuauugauaaggaaaccggugaggugcuccaucagaagacacacuuuccccaaccuugggaguucuuugcccaggagguuaugaucaggguguucgggaaaccagacggcaagccggaauuugaggaggcugauacccccgaaaaacugcguacucuucuggccgagaaguugucuagccggccugaagcaguacacgaguacgucacgccacucuucgugucaagagcucccaauaggaaaaugaguggacagggccauauggaaacaguuaaguccgccaagcgccuggacgagggggugagcguccuacgagugccucugacccagcucaaacugaaggaucuugagaaaaugguaaacagagaacgggagccaaaguuguaugaagcacugaaagccagguuagaggcucacaaggacgaucccgcgaaagccuuugcagaaccguucuacaaguaugacaaggcuggaaaucgcacucaacaggugaaagccguucgugucgaacaggugcaaaagaccggugugugggucagaaaccauaauggcaucgccgauaacgcuacaaugguucggguggacguguuugagaaagcagggaaguacuaucucguaccuauuuacucuuggcaggucgccaaaggaauacugccagauagggcggugguugcuuacgccgacgaagagggcuggaccgugaucgaugaaucauuccgcuuuaaguucguccuuuauaguaaugaccugauuaaggugcagcuuaaaaaggacagcuuccucgguuacuuuuccgggcuggaucgagcaacuggcgccaucucuuugagagagcacgaccuggagaaaucgaagggaaaagauggcaugcaccggauugggguuaagacagcucucagcuuccagaaguaucaaaucgacgaaaugggaaaagagauaagguuaugccgccugaagaaaagacccccugugagguga

SEQ ID NO: 2706 - RNA, 3246 nt, Artificial Sequence
  Cas9 variant
augaccgccuucaagcccaacccuaucaauuacauucugggccucgacauagggaucgcuagcgugggaugggcaauggucgagauugaugaagaggaaaacccaaucagacuuauugaccuggguguuaggguguuugagcgggccgaaguaccgaaaacaggcgauuccuuggcggcugcccgccgauuagcacguucugugagaaggcugacucggcgcagagcccacaggcuacuccgggcucgccgacugcuuaagagagaggggguccugcaggcagccgacuucgaugagaauggauugaucaaaucacuccccaacacgccuuggcaacugagggcugccgcgcuggaccggaagcucaccccauuagaauggagugcagugcugcuucauuugauaaaacaccguggcuaucugagccagcgcaagaaugagggugaaacagccgauaaggagcuaggggcucuccugaaaggaguugccgacaacgcacaugcccuucagacuggcgauuuuagaacccccgcugagcuggcggugaauaaguucgaaaaagaguccggccacaucaggaaccagcgaggggacuacucucauacauuuucgcggaaggauuugcaagccgaacucguccuguuauucgagaaacagaaggaauuuggaaauccucacauuucagacggucugaaggagggcaucgagacccuccuuauggcacagcgcccagcucugagcggggaugccgugcagaaaauguugggauauugcacuuucgaacccacagagccuaaggcugccaaaaacaccuacacggcagaaagauuuauuuggcuaacuaagcugaauaaccucaggauccuggagcaaggcagugaacggccacuuaccgacacagagcgcgccacucugauagacaugccguauaaaaauaaguugaccuacgcuaaagcgagagagcuccuggguuuagaugacacagcauucuuuaaggggcugagguauggaaaggauaacgccgaauccgcuacccuaauggagaugaaagccuaccacgcaauucgucgggcccucgaaaaggagggccugaaagacaagaaaucuccccuuagcuuguccccugaacugcaggaugagaucggcacggcuuucucacucuuuaagacugacgaggauauuacagggcgacugaagggaugucuucagccagaaauccuggacgccuugcucaaacauaucaauuucgauaaguucguacagauuagucugaaagcauuaagaaggauaguuccccugauggagcaagguaagcgcuacgacgaagcgugcgcugagaccuauggcgaucacuacggggagaaaaacagcgaagagaugcuauaucucccuccaauccccgccgacgaaauucggaacccggugguccugagagcacuuucucaggccaggaaggugaucaauggagugguccgccgauacggcuccccugcucggauacauauugagacugcccgugaaguugguaagucauuuaaagacagaaaggagaucgagaaaaggcaggaagagaaccgcaaggaucgggaaaaagcagcugccaaguucagagaguauuuucccaauuucgugggggaaccaaagagcaaagacaucuugaagcugaggcucuacgagcaacagcacggcaaaugucuguauaguggaaaggcgauugauauccgacgcuuaaacggcaaaggguacguagagauugaccacgcccugccuuuuucucggacaugggaugacuccuucaauaacaaggugcuugucuugggaagcgaaaaucagaacaaagguaauagaacccccuacgaguaucucaacggcaaggauaauucgagggaauggcuggaguuuaaggcucguguggaaacgucucgcuucccacauuccaaaaagcagcggguucuacugcaaaaauuugacgagaagggguucaaagagagaaaccucaaugauaccagguacgugaaccgauuucugugccaguucgucgcagaccacaugcagcuuacaggaaagggcaagcggcgcguguuugccucaaauggucagauaacuaacuugcugagaggguucuggggcuuacauaaaguaagggcugaaaacgaucggcaccaugcccucgacgcaguuguggucgcguguaguaccguggccaugcaacagaagaucacaugcuucguccgauauaaagagaugaaugcuuuugauggaaagacuguggacaaagaaaccggcgagguucugcaccagaagacacacuucccccagccuugggaguuuuucgcccaagaagugaugauuagaguauuugggaagccagacggaaaaccggaguucgaagaggcagauacccccgaaaaacuucgcgcucuguuggccgagaagcucagcuccaggccugaggcaguccaugaauacgugacuccacuguuuguuucucgugcccccaaccggaagaugagcggugcucacaaagacacgcuaagaucagcgaagagguucgugaagcauaaugagaaaaucagugucaagcgcguguggcugacagaaaucaaacucgccgaucuggagaacaugguaaauuauaagaacggccgagaaauugagcuuuacgaggcauugaaagcuagacugggggccuauggaggcaaugccaagcaggcuuuugacccuaaagauaacccauucuacaagaagggugggcaguuagugaaagcaguucgggucgaaaagacccaggaguccggcgugcuccugaauaaaaagaacgccuacacuauagcggacaauggagauauggugagggucgacguguuuuguaaaguugauaagaagggcaaaaaccaauauuucaucgugcccauuuacgcuuggcagguagccgaaaauauccuuccggacauugauugcaagggguaucgcaucgacgauagcuacaccuuuuguuucucucugcacaaauaugaccuaauagcauuccagaaggacgagaaaucaaaggucgaauuugccuacuauaucaacugcgauaguagcaauggacguuucuaccucgcuuggcacgacaagggcuccaaagagcaacaguuuagaauuucuacacagaaccugguguugaugcagaaguaccaaaucgaugagcuggguaaagaaauucggccuuguagguuaaagaaacgcccacccguucgauga

SEQ ID NO: 2707 - RNA, 3246 nt, Artificial Sequence
  Cas9 variant
auggccgcuuucaagcccaacccuaucaauuacauucugggccucgacauagggaucgcaagcgugggaugggccauggucgagauugaugaagacgagaacccaaucugccuuauugaucuggguguuagaguguuugaaagggcggagguaccgaaaaccggcgacuccuuggcugccgcacggcgcuuagcccgaucugugcguagacugacaaggcggcgcgcucacagacuacucagggcacggcgccugcuuaagcgagaagggguccugcaggccgcugauuucgacgagaauggauugaucaaaucacuccccaacacuccuuggcaacugagaagugccgcgcuggauaggaagcucacgccauuagaguggagcgcagugcugcuucauuugauaaaacaccggggcuaucugucccagcguaagaaugaaggugagaccgccgacaaggaacuaggggcucuccugaaaggaguugccaacaaugcacaugcccuucagacaggcgauuuucgcacucccgcugagcuggcguugaacaaguucgagaaagaaucuggccacaucagaaaucagcgaggggacuacucgcauaccuuuucacggaaggaucuccaagccgagcugauuuuacuguucgaaaaacagaaggaguuuggaaacccucacgugagcgguggccucaaggaagggaucgagacacuucugaugacccagcgaccagcauugaguggagacgcuguccagaaaaugcuaggccacuguacuuucgagcccgccgaaccuaaggcugccaaaaauacauauaccgcagagcgcuuuauuuggcugacgaagcucaacaaucugagaauccuugaacaagguuccgagaggccacugacugauaccgaacgggccacauugauggacgagccguaccgcaaaucuaagcucacuuaugcucaggcgagaaaacuguuagggcuggaggacaccgcauucuuuaagggacuaagguacggcaaggauaacgccgaagcuagcacacucauggagaugaaagccuaucaugcaauaucccgugcccuggaaaaggagggccuuaaagacaagaaaucacccuugaaucugaguccugaacuccaggaugagauugggaccgcuuucagccuguuuaagacggacgaggauaucacuggacggcuuaaggacaggauucagccagaaauccuggaggccuugcucaaacacaucucuuucgauaaguucgugcaaauuucccugaaagcauuaagaaggauaguaccccugauggaacaggguaagcgcuacgacgaggcgugcgcugagaucuacggcgaucauuaugggaaaaagaacacagaagagaagauuuaccuaccuccaauccccgccgacgaaauacggaacccgguugugcucagagcacugucacaggccaggaaagucauuaauggaguggugcgccgauauggcagcccugcucggauccacaucgagaccgcccgugaagucgguaagaguuuuaaagauagaaaggagauugagaaaaggcaagaagagaaccgcaaggaccgggaaaaggcagcugccaaauucagagaguacuuucccaauuucguuggggaaccaaagucuaaagacauccuuaaguugaggcuguaugagcagcagcacggcaaaugucucuacuccggaaaggagauuaaccugggccgauuaaaugaaaaaggguauguggagauagaucaugcgcugccuuuuagccgcacuugggacgauucguucaacaauaagguacuuguguugggaucugaaaaccagaauaaggguaaccaaacacccuacgaguacuuuaauggcaaagacaacucccgggaauggcaggaguucaaggccagagucgagaccucaagguuuccacguaguaaaaagcagcgcauccuccugcagaaauucgaugaagacggguuuaaggagcggaaucuaaacgauacgagauaugugaauagguuccugugccaauuuguugcugaccgaaugcggcucaccggaaagggcaaaaagcgcguguucgcaagcaacggucagauuacaaaccugcuuagaggguucuggggcuugaggaaaguccgggccgaaaaugaucgacaccaugcucuggacgccgugguaguugcauguuccacuguggcgaugcagcagaagaucaccagauuuguccgcuacaaagagaugaacgccuucgauggaaagacaaucgacaaggagacuggcgaaguguuacaccagaaaacccauuuuccccagccuugggaguucuuugcucaggaagucaugauuaggguguucgggaagccagauggaaaaccggaguuugaagaggccgacacacccgagaagcuccguacccugcuugcagaaaaacugucuagccggccugaggcuguucacgaauaugugacuccauuguucguaucaagagcccccaauaggaagaugaguggucagggccacauggagacggucaaguccgcaaaacgccucgacgaaggggugagcguucugcgagugccucuaacacaacugaagcucaaagaucuggagaagauggucaacagagagcgggaaccaaaacuuuacgaggccuugaaggcuaggcuggaagcgcauaaagacgaucccgccaaggcauuugcugagccguucuauaaguacgacaaagccggaaaucgcacccaacaggugaaggccguacguguggaacaaguucagaaaacuggcgucugggugagaaaccacaaugguauagcugauaacgcaaccauggugcgggucgacguuuuugagaaggccgggaaauauuacuuagugccuaucuacucuuggcaaguggcgaagggcauucucccagauagggcuguagucgccuaugcagacgaggaaggauggacagugaucgaugagucauuccgcuuuaaguucguucuguacaguaaugaccuuauuaaagugcagcugaagaaagauagcuuccuaggcuauuuuuccgggcucgaccgagccaccggagcuaucucucugagagaacaugauuuggagaagucgaaaggcaaggacgguaugcaccggauaggggucaagacugcacugagcuuccagaaauaccagaucgacgagaugggaaaggaaauuagguuaugccgccucaaaaagagacccccugugagguga

SEQ ID NO: 2708 - RNA, 3246 nt, Artificial Sequence
  Cas9 variant
augcugaagagagugcucggcaucgacgucgggauuagcuccauaggaugggcccuucuggaguuccagggugauaucgacaacaaagauuugcccucuggcaagauuuuagcuucagggguuaggguguuuacccaagcagaaaauccuaaaaacggagagagucuggccaagccacggcgcgacgcgcgacuagcucguagaaggacacggcgcagagcccagaggcucacugauaucaaagaccuguucuuuaaguacaaacuuguaacgggcauuagccggaauaaaaucaacuccauauauaagaccgaagagaauaaaaaggauccguggacacugcgcaaagaagcauuguaccgaaagcucgacggugaggaguucgccagagugcugacucacaucgcuaagcauaggggguuuaaaucuaugcggaagucggaagaggaaggaucagauaccaaagcaaaggagacacagcguguccugaccgagauuggcaaaaacaaggacacucucaaaacaggcaucuggcagaccgccggggaaaugauugcuagccgccccaagggagaugccagaaggaauaagacggacaguuauaaaaacuccaucucucgggaguuacugcaagaugaaacuaagauaauuuucgagaaacagcgagguaugaauagccaguuuaccuccgcggaccuugaaaaggaguacucagacaucgcauuccaccaggccccuauucaaaguauguugaaaauggugggcgggugcacauuugagaaggaugaagagggaaagcgccugaaaagagcuccaaagaacagcuauucugccgaaguuuucacugcacuaaccaaaaucaauaaccucgugcugaagacaaaaaccgcuaauaucaacgacagguuucuuacgacugaggaacggaagaaggcccuggaguugugucauuccaaugcgaaagucacauucaagcagcuccgcggcgagcuggguuuacccgaagauuggauuuuuaacaccguggacuacgccaaaaagccuaaaaagacugcaguaaaggagacagaaccagagucagcuugcuucuuccagaugagaggguauaacgaaauaaggaaaagcguuggaaaggaucuguggaccgagaucaguaugaaaaaggagauucucaauucuaucgugacgacccuugccacagaaaaauccgacgaggcuauaaaggcccagcugaaaaagagcgaaguccccgaugagauugcagagaagguguugggccuaaacuuucguggcuuccugcaccucucgaucaaagcccuggacaagaucauuccuuuuaugauggcuggggauaaauacacugacgcgugugauaaggcaggauacaaagaacaaaucucugguauuaagaagauauuccuucggaaacugaaugacgaggaaaacgagcagaucaccaauccaguggccaagcgagcuauuacacaguuuagaaaagucaucaacgccaucauuagggaauauggcaaguucgaccaaaugaauauagaguuggcacgcgaucucgccaaauccuacgacgaucggaagaagaucaaagaggggcaggaagacuuuagagcugagaaggauagggccgcacagcgcugcaaagacaacggacuggauccaaauucaaaggacaacuuaaguaaauaucgacugugggaacagcaagauaauggcuucuguauuuacugcgguaagcccaucgagcuacagcggcucgcggaacagggguauugugagguugaccauauucugccuuacagccguucccuugaugacucucagcacaacaagguguuggcucacauccaugauaaucaacagaaaaagaaccagauaccauuugagcacuucggcggagacggccccaaaugggaagaguuuguagggagacugaauagccaguucaagaaccucccuaaaucaaagcugaacaggcuugugaaacgcaaguuugacgaaaaggauauggagggauucaaagaacggaauaucaacgacacuagauauauuaguagguucaucaagaauuuugucgagaaccaucuggaguucgccgaauccgcacaaaaacagaagguguuuguucgaagcgguucuuugaccgccuuccuccgccaccaguggggccugauuaaaaagcgggaugagucagacagacaccaugcuuuagaugcccuggugacagcaugcgcuacccaggccauggucaagaguacugcgaucacggcccaaaagauggaaagcuacaauuggauaaacaaggagaaaccaaggaugccccuaccguggcucaauuuucgugacgaugugcagaagucccuggacgcuguauucguuucucgcgcaccucggcacaaagucgggggagccgcucauaaggagacaauuagaucgaucaggaaguguggcgaagagaaccuuauuaucgaaaagacccccuugguggauauagccacuaagagcgguaucaaacugaaggacauugagaaacucuacaagaaggaacagaaucgaaaacuguaugagaccuuaaaggagcggcuggaacaaaacgggaaugauccagugaaagcauuuggcaacccugacgaucccguccgcaugccaacaaaugaccuuaccaagacuggacccaucauuaaauccaucaaguugauaacaaacaagaaaucaggccucaaugugagagcggggauugccgacaacggagagaucgcuaggcuggauguuuacgaacggaaggguaaauucuaucuaaucccuaacuacguggccgacuuugcaaauaaggagcugccgaaaaaggcuauuaaagccaacacgccggaaaccgaguggcccaucauugaucgaaauuauaacuucaaguuuagucucuucaaggacgaucugauaucuaucaaacagaaacuugacagcccugaggaauuuuacuauuacaaaggcccagauguauccacugcaucaauuacagucgagagcguggacagaaagcgcuugugggaagagaaaaagaaggggaaaaucgaaaauguuuuccacaccaggauuggaacaaagacucugaaaucuuuccguaaguuuaacuuagauauccucggcaccaaagcccccguggagauaaagaaggagacgugggucggugugauccggaaaaaugggguagcuaacaauaccggcaacaaggcgauguga

SEQ ID NO: 2709 - RNA, 3249 nt, Artificial Sequence
  Cas9 variant
auggccgcuuucaagcccaacccuaugaauuacaucuuaggccucgacauugggauagcaagcgugggaugggccauggucgagaucgauaaagaagagaacccaauuagacuuaucgaccuggguguuaggguguuugaacgggcggagguaccgaagaccggcgauuccuuggcuauggcccgccgauuagcacguucugugagaaggcugacacggcgcagagcccacaggcuacuccgggcucgccgacugcuuaaaagagaagggguccugcaggacgcagauuucgacgagaauggauuggugaagucacuccccaacacuccuuggcaacugagggccgcugcccuggaucggaaacucacgugcuuagaguggagugcgguucugcuucauuugauuaagcaccguggcuaucugagccagcgcaagaaugaaggugagaccgcagacaaagaacuaggggcccuccugaagggaguggcugauaacgcccaugcacuucagacaggcgacuuuagaacuccagcugagcuggccuugaauaaauucgagaaggaauccggccacaucaggaaccagcgaggggauuacucucauaccuuuucgcggaaagaccuccaagcggagcugaauuuacuguucgaaaagcagaaggaguuuucaaacccccacgucagcgauagucucaaagaaggaauagagacacuucugauggcccagcgcccugcauuguccggugacgcugugcagaagaugcuaggccacuguaccuucgagccagccgaacccaaagcugccaagaauacuuauacagcagagagauuuaucuggcugaccaaacucaacaaucugaggauucuugaacaagggucugagcggccucugacggacacugaacgcgccaccuugauggaugagccauacagaaagagcaaacucacauaugcucaggcgaggaagcuguuaggacuggaggacacugcauucuuuaagggccuacguuacgguaaagauaacgccgaagcuccgacccucauggagaugaaggccuaucaugcaaucucccgggcccuggaaaaagaggggcuuaaggacaaaaagucacccuugaaucugaguacagaacuccaggaugagauuggaaccgcuuucagccuguuuaagacggacaaagauaucacuggccgacuuaaggacagaguacagccugagauacuggaagccuugcucaaacacauuucuuucgauaaguucguucaaaucucccugaaagcauuaaggcgcauugugccacugauggagcagggcaagcgguacgacgaagcgugcgcugagaucuacggggaucauuauuguaagaaaaacgccgaggaaaagaucuaccuacccccuauuccagcagacgagauaagaaaccccgucgugcucagggcccugucacaggcucgcaaagugaucaauugcgucguucgacgguauggaagcccggcccguauucacaucgaaacagcaagagagguggguaagaguuuuaaagacaggaaggaaauagagaagcgccaagaggaaaaccggaaagauagagagaaggcugccgcgaaauucagggaauacuuuccuaauuucguaggcgagcccaagucuaaagacauucuuaaguugcgacuguaugaacagcagcacgggaaaugucucuacuccggaaaggagaucaaccuggugcgcuuaaaugagaagggcuaugucgaaaucgaucaugcccugccauuuagccggaccugggacgauucguucaacaauaaagugcuuguuuuggguucugagaaccagaauaaggggaaccaaacuccuuacgaauacuuuaauggcaaagacaacuccagagaguggcaggaguucaaggcuaggguggaaacaucacguuuuccccgcaguaaaaagcagcggauucuccugcagaaguucgaugaggaaggauuuaaagagagaaaucuaaacgacaccagguaugucaaucgauuccugugccaauuuguggcagaucacauccuccugacgggcaaggggaaacggcgcguauucgccagcaacggacagauuaccaaccuuuugagagguuucuggggccugaggaagguucgggcugaaaaugaccgacaucacgccuuagaugcaguggucguggcguguuccacagucgccaugcagcagaaaauaacuagauuugugcgcuacaaggagaugaacgcuuucgacgggaagaccaucgauaaagagacaggagaaguucuccaucaaaaggcccacuuuccacagcccugggaguucuuugcacaggaagugaugauuaggguauucggcaaaccugacgguaagccagaguuugaagaggcugacacuccggagaaacugcguacccuucuggccgaaaaguugucuagccggcccgaggcaguccacgaauaugugacaccucucuucguuucaagagccccaaauaggaagaugagugggcagggccauauggagaccgugaaauccgcuaagcgccuggaugaaggaaucagcguccuacgagugccccugacucaacucaaacugaagggccuugagaaaaugguaaacagagagcgggaaccuaaguuguacgacgcgcugaaagcccaguuagagacgcacaaggauaauccagcaaaggcuuuugccgaacccuucuauaaauacgacaaggccgggaacaggacacagcaagugaaagcuguucgcaucgagcagguccagaagaccggagugugggugcguaaucauaacgguauugcagauaaugccacuauggucagaguugacguguuugaaaaaggcgggaaguauuaccucgugccgauauacucuuggcagguagcgaagggaauccugccugaucgggcugucguggccuucaaagacgaggaggauuggaccguuauggacgauucauuugaguucagguucgugcuuuaugcaaacgaccugauuaagcuaacagccaaaaagaaugaauuucucggcuacuucgucagucugaaccgcgcuaccggugcaaucgauauucgaacucacgacacagacagcacgaaagggaagaauggcaucuuucaauccgugggaguuaagaccgccuugucuuuccagaaaaaccagauagaugaacugggcaaggagaucagaccaugccggcugaaaaagaggcccccugugcgcuga

SEQ ID NO: 2710 - RNA, 3249 nt, Artificial Sequence
  Cas9 variant
auggccgcuuucaagcccaacccuaucaauuacauucugggccucgacauagggaucgcaagcgugggaugggccauggucgagauugaugaagaggaaaacccaaucagacuuauugaccuggguguuaggguguuugagcgggcggaaguaccgaaaaccggcgauuccuuggcuauggcccgccgauuagcacguucugugagaaggcugacacggcgcagagcccacaggcuacuccgggcucgccgacugcuuaagagagaggggguccugcaggcagccgacuucgaugagaauggauugaucaaaucacuccccaacacuccuuggcaacugagggcugccgcgcuggaccggaagcucacgccauuagaauggagugcagugcugcuucauuugauaaaacaccguggcuaucugagccagcgcaagaaugagggugaaaccgccgauaaggagcuaggggcucuccugaaaggaguugccaacaaugcacaugcccuucagacaggcgacuuuagaacucccgcugagcuggcguugaacaaguucgaaaaagaguccggccacaucaggaaucagcggggagauuacucucauaccuuuucgcgaaaggaccuccaagccgaacugauuuuacuguucgagaaacagaaggaauuuggaaacccucacgugucagguggccucaaggaggggaucgagacacuucugaugacccagcgcccagcauugagcggagaugcuguccagaaaaugcuaggccacugcacuuucgaacccgccgagccuaaggcugccaaaaauacauauaccgcagaaagauuuauuuggcugacgaagcucaacaaucugaggauccuugagcaagguagugaacggccacugacugacaccgagcgcgccacauugauggaugagccguacagaaaauccaagcucacuuaugcucaggcgaggaaacuguuagggcuggaagacaccgcauucuuuaagggacuacguuacggcaaggacaacgccgaggcuucuacacucauggaaaugaaagccuaucaugcaauaagccgggcccuggagaaggaaggccuuaaagauaagaaaucccccuugaaucugucaagugagcuccaggacgagauugggaccgcuuucagccuguuuaagacggaugaagacaucacuggacgacuuaaggauagagugcagccugagauucuggaagccuugcucaaacacaucucuuucgacaaguucguacaaaucucccugaaagcauuaaggcgcauuguuccacugauggagcaggguaagcgguacgaugaggcgugugcugaaauauacggcgaccauuaugggaaaaagaacacagaggaaaagaucuaccuacccccuauuccagccgaugagaucagaaaccccgugguccucagggcacugucacaggcccgcaaagugauaaauggagugguccgacgguauggcagcccggcucguauucacaucgaaaccgccagagagguugguaagaguuuuaaagacaggaaggagaucgaaaaacgccaagaggaaaaccggaaggauagagagaaggcagcugccaaauucagggaauacuuuccuaauuucgugggggagcccaagucuaaagacauucuuaaguugcgacuguaugagcagcagcacggcaaaugccucuacuccggaaaggaaaucaaccugguacgcuuaaaugagaaaggcuauguggaaauugaccaugcgcugccauuuagccggacuugggaugacucguucaacaauaagguccuuguguuggggucugagaaccagaauaagggaaaccaaacaccuuacgaauacuuuaaugguaaagauaacuccagagaguggcaggaguucaaggccaggguugaaaccucacguuuuccccgcaguaaaaagcagcggauacuccugcagaaauucgacgaggauggcuuuaaggaauguaaucuaaacgacacgagauaugugaauagguuccugugccaauuugucgcugaucacauccuccugaccgggaagggaaaacgacggguguucgcaagcaacggccagauuacaaaccuuuugcgcgguuucugggggcugagaaagguaagggccgagaaugaccggcaucacgcuuuagaugccguuguggucgcauguuccacuguggcgaugcagcagaaaaucacccgauuugucagauacaaggagaugaacgccuucgacggcaaaacaaucgauaaggaaacuggaaaggugcuccaucagaaaacccacuuuccacagcccugggaguucuuugcucaggaaguuaugauucgcguguucggcaagccugacgggaaaccagaguuugaagaggccgauacaccggagaagcugaggacccuucuggcagaaaaauugucuagccgucccgaggcuguacacgaauaugucacuccucucuucgugucacgggccccaaauagaaagaugaguggacagggucauauggagacgguuaaguccgcaaaaaggcuggacgaaggcgugagcguccuacgcgugccccugacacaacucaagcugaaagaccuugagaagaugguaaaccgagagagagaaccuaaauuguacgaggcccugaaggcucgguuagaagcgcacaaagaugacccagccaaggcauuugcugagcccuucuauaaguacgauaaagccgggaauaggacccaacaggugaaggccguucgcgucgaacaagugcagaaaacuggaguguggguccguaaccauaauggcauagcugacaacgcaaccaugguuagaguggauguguuugagaagggugacaaauauuaccucguaccgaucuacucuuggcaggucgccaaggggauucugccugaucgggcggugguucagggcaaggacgaggaagauuggcaacuuaucgacgauucauucaauuuuaaauucagucugcacccaaacgaccuaguggaggucauuacaaagaaagcuaggauguucggauauuuugccagcugccaccgcggcaccgggaauaucaacauacgaauccaugaucucgaccacaagauugggaaaaauggcauccuggaagguauuggggugaagacugcauuguccuuccagaaguaccagaucgacgagcugggaaaagagauaagacccugucgguuaaagaaaaggccucccguucgcuga

SEQ ID NO: 2711 - RNA, 3249 nt, Artificial Sequence
  Cas9 variant
auggccgcuuucaagcccaacccuaucaauuacauucugggccucgacauagggaucgcaagcgugggaugggccauggucgagauugaugaagacgagaacccaaucugccuuauugaucuggguguuagaguguuugaaagggcggagguaccgaaaaccggcgacuccuuggcuauggcccggcgcuuagcacgaucugugcguagacugacaaggcggcgcgcccacagacuacucagggcucggcgccugcuuaagcgagaagggguccugcaggcagccgauuucgacgagaauggauugaucaaaucacuccccaacacuccuuggcaacugagagcugccgcgcuggauaggaagcucacgccauuagaguggagugcagugcugcuucauuugauaaaacaccggggcuaucugagccagcguaagaaugaaggugagaccgccgacaaggaacuaggggcucuccugaaaggaguugccgauaacgcacaugcccuucagacaggcgacuuucgcacucccgcugagcuggcguugaauaaguucgagaaagaauccggccacaucagaaaccagcgaggggauuacucucauaccuuuucgcggaaggaccuccaagccgagcugauuuuacuguucgaaaaacagaaggaguuuggaaauccucacgugucagguggccucaaggaagggaucgagacacuucugaugacccagcgaccagcauugagcggagaugcuguccagaaaaugcuaggccacuguacuuucgagcccgccgaaccuaaggcugccaaaaacacauauaccgcagagcgcuuuauuuggcugacgaagcucaauaaccugagaauccuugaacaagguagugagaggccacugacugacaccgaacgggccacauugauggacgagccguaccgcaaauccaagcucacuuaugcucaggcgagaaaacuguuagggcuggaggauaccgcauucuuuaagggacuaagguacggcaaggacaaugccgaggcuucuacacucauggaaaugaaagccuaucaugcaauaagccgugcccuggaaaaggagggccuuaaagauaagaaaucccccuugaaccugucaccugaacuccaggacgagauugggaccgcuuucagucuguuuaagacggaugaggacaucacuggacggcuuaaggauaggauucagccagaaauccuggaggccuugcucaaacacaucagcuucgacaaguucgugcaaauuucucugaaagcauuaagaaggauaguaccccugauggaacaggguaagcgcuacgaugaggcgugcgcugagaucuacggcgaccauuaugggaaaaagaauacagaagagaagauuuaccuaccuccaauccccgccgaugaaauacggaacccgguugugcucagagcacugucccaggccaggaaagucauuaacggaguggugcgccgauauggcucacccgcucggauccacaucgagaccgcccgugaagucgguaagagcuuuaaagacagaaaggagauugagaaaaggcaagaagagaaucgcaaggaccgggaaaaggcagcugccaaauucagagaguacuuucccaacuucguuggggaaccaaagaguaaagauauccuuaaguugaggcuguaugagcagcagcacggcaaaugucucuacucuggaaaggagauuaaucugggccgauuaaacgaaaaaggguauguggagauagaccaugcgcugccuuuuucccgcacuugggaugacagcuucaauaacaagguacuuguguugggaucggaaaaucagaacaaggguaaucaaacacccuacgaguacuuuaacggcaaagauaauucucgggaauggcaggaguucaaggccagagucgagaccuccagguuuccacguaguaaaaagcagcgcauccuccugcagaaauucgacgaagauggguuuaaggagcggaaccuaaaugacacgagauaugugaacagguuccugugccaauuuguugcugaucgaaugcggcucaccggaaagggcaaaaagcgcguguucgcaucaaauggucagauuacaaaccugcuuagaggguucuggggcuugaggaaaguccgggccgaaaacgaccgacaccaugcucuggaugccgugguaguugcauguagcacuguggcgaugcagcagaagaucaccagauuuguccgcuacaaagagaugaaugccuucgacggaaagacaaucgauaaggagacuggcgaaguguuacaccagaaaacccauuuuccccagccuugggaguucuuugcucaggaagucaugauuaggguguucgggaagccagacggaaaaccggaguuugaagaggccgacacacccgagaagcuccguacccugcuugcagaaaaacuguccucucggccugaggcuguucacgaauaugugacuccauuguucguaagcagagcccccaacaggaagaugucaggucagggccacauggagacggucaagagugcaaaacgccucgaugaagggguguccguucugcgagugccucuaacacaacugaagcucaaagaccuggagaagauggucaauagagagcgggaaccaaaacuuuacgaggccuugaaggcuaggcuggaagcgcauaaagaugaccccgccaaggcauuugcugagccguucuauaaguacgauaaagccggaaaccgcacccaacaggugaaggccguacguguggaacaaguucagaaaacuggcgucugggugagaaaucacaacgguauagcugacaaugcaaccauggugcgggucgauguuuuugagaagggggacaaauauuacuuagugccuaucuacagcuggcaaguggccaagggcauucucccagauagggcgguaguccagggaaaggacgaggaagauuggcagcugaucgacgauucuuucaacuuuaaauucucacuucaucccaaugaccugguggagguuauuacaaagaaagcucgcauguucggcuauuuugccaguugccaccgagggaccggaaacaucaauauaagaauccacgaccuagaucauaagauuggcaaaaacgguauccucgaagggauuggagugaagacugcacugagcuuccagaaguaccagaucgacgaguugggcgaggaaauacggccuuguaggcugaaaaagcgcccuccagucagauga

SEQ ID NO: 2712 - RNA, 3249 nt, Artificial Sequence; identical to SEQ ID NO: 2550
  Cas9 variant

SEQ ID NO: 2713 - RNA, 3249 nt, Artificial Sequence
  Cas9 variant
auggccgcuuucaagcccaacccuaucaauuacauucugggccucgacauagggaucgcaagcgugggaugggccauggucgagauugaugaagacgagaacccaaucugccuuauugaucuggguguuagaguguuugaaagggcggagguaccgaaaaccggcgacuccuuggcugccgcacggcgcuuagcccgaucugugcguagacugacaaggcggcgcgcucacagacuacucagggcacggcgccugcuuaagcgagaagggguccugcaggccgcugauuucgacgagaauggauugaucaaaucacuccccaacacuccuuggcaacugagagccgcggcacuggauaggaagcucacgccauuagaguggagugccgugcugcuucauuugauaaaacaccggggcuaucugagccagcguaagaaugaaggugagaccgcugacaaggaacuaggggcccuccugaaaggaguugcagauaacgcucaugcccuucagacaggcgacuuucgcacucccgcggagcuggccuugaauaaguucgagaaagaauccggccacaucagaaaccagcgcggggauuacucucauaccuuuucgcggaaggaccuccaagcagagcugauuuuacuguucgaaaaacagaaggaguuuggaaauccucacgugucagguggccucaaggaagggaucgagacacuucugaugacccagcgaccagcuuugagcggagaugccguccagaaaaugcuaggccacuguacuuucgagcccgcugaaccuaaggccgccaaaaacacauauaccgcagagcgcuuuauuuggcugacgaagcucaauaaccugagaauccuugaacaagguagugagaggccacugacugacaccgaacgggcuacauugauggacgagccguaccgcaaauccaagcucacuuaugcgcaggcaagaaaacuguuagggcuggaggauaccgccuucuuuaagggacuaagguacggcaaggacaaugcugaagccucuacacucauggagaugaaagcauaucaugccauaagccgugcucuggaaaaggagggccuuaaagauaagaaaucccccuugaaccugucaccugaacuccaggacgagauugggaccgccuucagucuguuuaagacggaugaggacaucacuggacggcuuaaggaucgagugcagccagaaauucuggaggcauugcucaaacacaucagcuucgacaaguucguacaaaucucucugaaagcguuaagaaggauuguuccccugauggaacaggguaagcgcuacgaugaggcuugcgccgagauauacggcgaccauuaugggaaaaagaauacagaagagaagaucuaccuaccuccaauucccgcagaugaaauccggaacccggugguccucagagcccugucccaggcuaggaaagugauaaacggagugguccgccgauauggcagcccugcccggauucacaucgagaccgcacgugaaguugguaagucauuuaaagacagaaaggagaucgagaaaaggcaagaagagaaucgcaaggaccgggaaaaggcugccgcgaaauucagagaguacuuucccaacuucgugggggaaccaaagaguaaagauauucuuaaguugaggcuguaugagcagcagcacggcaaaugucucuacucuggaaaggagaucaaucugggccgauuaaacgaaaaaggguauguagagauugaccaugcccugccuuuuucccgcacuugggaugacagcuucaauaacaaggugcuugucuugggaucggaaaaucagaacaaggguaaucaaacacccuacgaguacuuuaacggcaaagauaauucucgggaauggcaggaguucaaggcuagaguggagaccuccagguuuccacguaguaaaaagcagcgcauacuccugcagaaauucgacgaagauggguuuaaggagcggaaccuaaaugacacgagauauguuaacagguuccugugccaauuuguggcagaucgaaugcggcucaccggaaagggcaaaaagcgcgucuucgccucaaauggucagaucacaaaccugcuuagaggguucuggggcuugaggaaagugcgggcugaaaacgaccgacaccaugcccuggaugcaguaguuguggcguguagcacugucgccaugcagcagaagauuaccagauuugugcgcuacaaagagaugaaugcuuucgacggaaagacaaucgauaaggagacuggcgaagucuuacaccagaaaacccauuuuccccaaccuugggaguucuuugcccaggaagugaugaucaggguuuucgggaagccagacggaaaaccggaguuugaagaggcagacacacccgagaagcuccguacccugcuugcugaaaaacuguccucucggccugaggccgugcacgaauauguaacuccauuguucgucagcagagcacccaacaggaagaugucaggucagggccacauggagacggugaagagugccaaacgccucgaugaagggguuuccgugcugcgagucccucuaacacaacugaagcucaaagaccuggagaagauggugaauagagagcgggaaccaaaacuuuacgaggcuuugaaggcgaggcuggaagcccauaaagaugaccccgcaaaggcuuuugccgagccguucuauaaguacgauaaagccggaaaccgcacccagcagguaaaggcugugcguguugaacaaguccagaaaacuggcgugugggugagaaaucacaacgguauugcagacaaugccaccaugguccggguugauguguuugagaagggggacaaauauuacuuagugccuauauacagcuggcagguagcgaagggcauccucccagauagggcugucgugcagggaaaggacgaggaagauuggcaacugauugacgauucuuucaacuuuaaauucucacuucaucccaaugaccugguugaggugaucacaaagaaagcccgcauguucggcuauuuugcaaguugccaccgagggaccggaaacauuaauaucagaauacacgaccuagaucauaagaucggcaaaaacgguauucucgaagggaucggagucaagacugcccugagcuuccagaaguaccagauugacgaguugggcaaagagauccggccuuguaggcugaagaaaaggcccccagugagauga

SEQ ID NO: 2714 - RNA, 3249 nt, Artificial Sequence
  Cas9 variant
auggccgcuuucaagcccaacccuaucaauuacauucugggccucgacauagggaucgcaagcgugggaugggccauggucgagauugaugaagaggaaaacccaaucagacuuauugaccuggguguuaggguguuugagcgggcggaaguaccgaaaaccggcgauuccuuggcuauggcccgccgauuagcacguucugugagaaggcugacacggcgcagagcccacaggcuacuccggacucgccgacugcuuaagagagaggggguccugcaggcugcaaauuucgacgagaacggauugaucaaaucacuccccaauacgcuguggcaacugagggccgcugcccucgaucggaaguuaaccccucuggaauggagugcggugcuuuugcaucugauaaaacaccguggcuaucuaagccagcgcaagaacgagggugaaacagcagacaaggagcucggggcccugcuuaaaggaguugcuggcaaugcccaugcacugcagacuggcgauuuuagaaccccagcugaguuggcccucaacaaguucgaaaaagaguccgggcacaucaggaaucagcggggagacuacucucauacauuuucgcgaaaggaucugcaagcggaauuaaaccuccucuucgagaaacagaaggaauuugguaauccccacauuucagacggccuuaaggaggggaucgagacccuguugaugacucagcgcccugcccuaagcggagaugcagugcagaaaaugcugggccacugcacauucgaaccaaccgagcccaaggcugccaaaaacacguauacuaccgaaagauuuauuuggcucacaaagcugaauaaccuuaggauccuggagcaagguagugaacggccuuugacugacaccgagcgcgcuacacucauggaugagccauacagaaaauccaagcugaccuaugcccaggcaaggaaauuacuggaacuagacgacauagccuucuuuaaggggcuccguuacggaaaggauaaugcugaggcgucuacgcugauggaaaugaaagcauaucaugccauuagccgggcucuugagaaggaaggcuugaaagacaagaaauccccgcugaaccucucacccgagcugcaggaugagaucggcacugccuucagucuuuuuaagacagacgaagauauuaccgggcgacugaaggacagaauccagccugagaucuuggaagcacuccugaaacacauuaacuucgauaaguucguccaaaucagcuuaaaagcccugaggcgcauagugccacuaauggagcagggaaagcgguacgacgaggcuugugccgaaauuuacggugaucauuauggcaaaaagaauacugaggaaaagaucgaccugcccccuauaccagcagaugagauucacaaccccguaguucugagagcgcuuucucaggcuaggaaagugaucaauggggucgugcgccgauacggauccccggcccggauccacauugaaacagcacgugaggugggcaagucauuuaaagacagaaaggagaucgagaaaaggcaagaagaaaaccgcaaggaccgggagaaggccgcugccaaauucagagaauauuuuccuaauuucgucggugagcccaagagcaaagauauuuugaagcugaggcucuacgagcagcagcaugggaaaugccuguauaguggcaaggaaauaaacuuaggacgacugaaugagaaaggcuacguugaaaucgaccacgcacuuccauuuucucgcaccugggaugacuccuucaacaauaagguguugguacucgggagcgagaaccagaauaagggaaaccaaacgccuuaugaauacuuuaaugguaaagauaacucgcgggaguggcaggaguucaaggcuagaguggaaaccucuagguuuccccguuccaaaaagcagcgcauucugcuacagaaauucgacgaggauggcuuuaaggaacggaaucugaacgacacaagauacgucaacagguuccucugucaauuuguggccgaucgaaugcggcugacugggaagggcaaaaagcgcguuuucgcgucaaauggacagaucaccaaccuuuugagagguuucugggggcugaggaaagugcgggccgagaaugaccgacaucacgcuuuagaugcagucgugguagccugcaguacaguugcuaugcagcagaagaucacuagauuugugcgcuauaaagagaugaacgccuucgacggcaagaccauugauaaggaaacaggagagguccuccaucagaaaacccacuuuccacagcccugggaguucuuugcacaggaagugaugauaagggucuucggcaagccugacgggaaaccagaauuugaggaggcggacacuccggaaaagcugcguacgcuucugacagagaaauugagcucccggcccgaagccgugcacgaguacguuaccccucucuucgugucuagagcuccaaauaggaagaugagcggacagggucauauggaaacuguaaagucagccaaacgccuggaugagggcaucaguguccuacgagugccccugacccaacucaagcugaaagaccuugagaagaugguuaacagagaacgggagccuaaauuguaugaagcacugaaggcuagguuagaggcccacaaagaugacccagcaaaggccuuugcugaacccuucuacaaguaugauaaagcggggaaucgcacacaacaggugaaggccaugcgugucgagcaagugcagaaaaccggaguaugggugagaaaccauaauggcauugcagacaacgcuacuaugguucgggucgauguguuugagaagggugacaaauacuaucucgugccgaucuacuccuggcaggucgccaaggggauucugccugauagggccguugugcagggcaaggacgaagaggauuggcaacuuaucgacgauagcuucaauuuuaaauucucucugcacccaaacgaccuaguggaaguaauaacaaagaaagcucgcauguucggauacuuugcaucaugucaccgaggcacggggaauaucaacauuagaauccaugaccucgaucacaagauuggcaaaaauggaauccuggaggguauaggggucaagaccgccuugaguuuccagaaguaucagauugacgagcugggaaaagaaauccggcccugcagguuaaagaaacgcccucccgugagauga

SEQ ID NO: 2715 - RNA, 3249 nt, Artificial Sequence
  Cas9 variant
auggccgcuuucaagcccaacccuaucaauuacauucugggccucgacauagggaucgcaagcgugggaugggccauggucgagauugaugaagacgagaacccaaucugccuuauugaucuggguguuagaguguuugaaagggcggagguaccgaaaaccggcgacuccuuggcuauggcccggcgcuuagcacgaucugugcguagacugacaaggcggcgcgcccacagacuacucagggcucggcgccugcuuaagcgagaagggguccugcaggcagccgauuucgacgagaauggauugaucaaaucacuccccaacacuccuuggcaacugagagcugccgcgcuggauaggaagcucacgccauuagaguggagugcagugcugcuucauuugauaaaacaccggggcuaucugagccagcguaagaaugaaggugagaccgccgacaaggaacuaggggcucuccugaaaggaguugccgauaacgcacaugcuuuacagacaggcgacuuucgcacucccgccgagcuggcguugaauaaguucgagaaagaauccggccacaucagaaaccagaggggagauuacucucauaccuuuucgcggaaggaccuccaagccgagcugaauuuacuguucgaaaaacagaaggaguuugggaacccucacauuucagauggucucaaggaaggcaucgagacacuucugaugacccagcgaccagcauugagcggggacgcugugcagaaaaugcuaggacacuguacuuucgagcccgccgaaccuaaggcugccaaaaauacauauaccgcagagcgcuuuauuuggcugacgaagcucaacaaucugagaauccuugaacaaggcagugagaggccacugacugacaccgaacggacaacuuugauagaugagccguaccgcaaauccaagcucaccuaugcccaggcuagaaaacuguuagagcuggacaacacagcguucuuuaagggucuaagguacgggaaggauaaugcagaagccucuacccucauggagaugaaggcuuaucaugccauuagccgugcacuggaaaaagagggacuuaaagacaagaaaucccccuugaaccugucaccugaacuccaggaugagaucggcacggccuucagucuguuuaagacugacgaggauauuacaggccggcuuaaggaccgaguccagccagaaauccuggaggcuuugcucaaacacaucagcuucgauaaguucgugcaaauuucucugaaagccuuaagaaggauaguaccccugauggaacaggggaagcgcuacgacgaggcaugcgcggagaucuacggagaucauuaugguaaaaagaacaccgaagagaagauugaccuaccuccaauccccgcugacgaaauacggaauccgguugugcucagagcccugucccaggcaaggaaagucauuaacggcguggugcgccgauacgggagcccugcccggauccacaucgagacugcucgugaagucggaaagucauuuaaagauagaaaggagauugagaaaaggcaagaagagaaucgcaaggaccgggaaaaggccgcaacaaaauucagagaguauuuucccaacuucguuggcgaaccaaagaguaaagauauccuuaaguugaggcuguacgagcagcagcacgguaaaugucucuauucugggaaggagauuaaucugggccgauuaaacgaaaaaggauacguggagauagaccaugcucugccuuuuucccgcaccugggaugacagcuucaauaacaagguacuuguguugggcucggaaaaucagaacaaggggaaucaaacgcccuaugaguacuuuaacggaaaagauaauucucgggaauggcaggaguucaaggccagagucgagaccuccagguuuccacguaguaaaaagcagcgcauccuccugcagaaauucgacgaagaggguuuuaaggaacggaaccuaaaugauacaagauacgugaacagguuccugugccaauuuguugcggaccacaugcuccugacuggcaaggggaaacgacggguguucgccucaaacggacagauuaccaaucuuuugcgcggcuucuggggucugagaaaggucagggcugagaacgaucggcaucacgcauuagacgccgugguaguugcuuguagcacaguggccaugcagcagaaaaucacucgauuugucagauauaaggagaugaaugcauucgaugggaaaaccaucgacaaggaaacaggcgaggugcuccaucaaaagacccacuuuccccagccuugggaguucuuugcgcaggaagucaugauucgcguguucggaaaaccagacggcaagccggaauuugaggaggccgauacucccgaaaaacugaggacgcuucuggcugagaaguuguccucucguccugaagccguucacgaguacgugacaccacucuucguaagccgggcacccaacagaaaaaugucagggcagggacauauggaaaccgucaagagugcuaagaggcuggacgaggguguguccguucuacgcgugccucugacucaacucaaacugaaggaucuugagaaaauggucaaucgagaaagagagccaaaguuguaugaagcccugaaagcacgguuagaggcccacaaggacgaucccgcuaaagcguuugccgaaccguucuacaaguaugacaaggcaggcaacaggacccaacaggugaaagcuguacgcguggagcagguucagaagacaggggucugggugcguaaucauaacggaauagccgauaaugccaccauggugagagucgacguuuuugagaaaggcgauaaguacuaucucgugccuaucuacagcuggcaaguggcuaaagguauucugccagaccgggcaguaguccaggggaaggaugaagaggacuggcagcuuaucgaugacucuuucaacuuuaaguucucacugcaccccaaugaccuaguggaaguuauuacuaaaaaggccaggauguucggcuacuuugcgaguugccaccgcggaacaggcaacaucaauauacgaauccaugaucucgaccacaaaauugggaagaacggaauccuggagggcauuggugugaaaacggcuuugagcuuccagaaguaucagaucgaugagcuggggaaggaaauaagaccuugucggcuuaaaaagaggcccccaguccgcuga

SEQ ID NO: 2716 - RNA, 3249 nt, Artificial Sequence
  Cas9 variant
auggccgcuuucaagcccaacccuaugaauuacauccugggccucgacauugggauagcaagcgugggaugggccaucgucgagauugaugaagaggaaaacccaaucagacuuauugaccuggguguuaggguguuugagcgggcggaaguaccgaaaaccggcgauuccuuggcugccgcacgccgauuagcccguucugugagaaggcugacacggcgcagagcucacaggcuacuccgggcacgccgacugcuuaagagagaggggguccugcaggccgcugacuucgaugagaauggauugaucaaaucacuccccaacacuccuuggcaacugagggccgcggcacuggaccggaagcucacgccauuagaauggagugccgugcugcuucauuugauaaaacaccguggcuaucugagccagcgcaagaaugagggugaaaccgcugauaaggagcuaggggcccuccugaaaggaguugcagacaacacacaugcccuucagacuggcgauuuuagaacccccgcugagcuggcguugaauaaguucgaaaaagaguccggccacaucaggaaccagcgaggggacuacucucauacauuuaaucggaaggaucuccaagccgaacugaacuuacuguucgagaaacagaaggaauuuggaaauccucacgugucggacggucucaaggagggcauugagacccuucugaugacucagcgcccagcauugucaggggaugcuguccagaaaaugcuaggacacugcacauucgaacccaccgagccuaaggccgcuaaaaacacguauacugccgaaagauuuguguggcugaccaagcucaauaaccugaggauccuugagcaaggcagcgaacggccacugacagacacugagcgcgcaaccuugauggacgagccguacagaaaaaguaagcucacauaugcccaggcuaggaaacuguuagaucuggacgauaccgcguucuuuaagggucuacguuacgggaaggacaaugcagaagccuccacgcucauggagaugaaggcuuaucaugccauuucucgggcacuggaaaaagagggacuuaaagauaagaaaagccccuugaaccuguccccugaacuccaggacgagaucggcacugccuucucacuguuuaagacagaugaggacauaaccggccgacuuaaggauagaguacagccagaaauucuggaggcuuugcucaaacacaucaguuucgacaaguucguucaaauuagccugaaagccuuaaggcgcaucgugccccugauggaacaggggaaccgguacgaugaggcauguacugagaucuacggagaccauuaugguaagaaaaauacagaagagaagauuuaccuaccuccaauacccgcggacgaaaucagaaacccggucgugcucagggcucugucucaggcccgcaaggugauuaauggcgucguucgacgguauggguccccugcacguauccacauagagaccgccagagaagugggaaaaucauuuaaggauaggaaagagauugagaagcgccaagaagagaaccggaaagacagagaaaagagcgcugccaaguucagggaguacuuucccaauuucguaggcgaaccaaaaaguaaggauauccuuaaauugcgacuguaugagcagcagcacgguaagugccucuacucugggaaagagaucaaccugggccgcuuaaaugaaaagggauauguggagauugaccaugcacugccuuuuucccggacgugggaugacagcuucaacaauaaaguccuugcuuugggcucggaaaaccagaauaaggggaaccaaacccccuacgaguacuuuaauggaaaggauaacucuagagaauggcaggaguucaaagccaggguggagacaucccguuuuccacgcucaaagaaacagcggauccuccugcagaaguucgacgaagaugguuuuaaagagagaaaucuaaacgacacuagguauauuaaccgauuccugugucaauuuguugcggaucacaugcuccugaccggcaaggggaagcggcgcguguucgccaguaauggacagauaacaaaccuuuugagaggcuucuggggucugaggaaaguccgggcugaaaaugaccgacaucacgcauuagaugccgugguaguugcuugcagcacuaucgccaugcagcagaagauuaccagauuugugcgcuacaaagagaugaacgcauucgacgggaagacaaucgacaaagagaccggcgaaguccuccaucaaaaggcgcacuuuccccagccuugggaguucuuugcccaggaagugaugaucagggucuucggaaagccagauggcaaaccggaguuugaagaggcugacacucccgagaagcugcguacgcuucuggccgaaaaauuguccucucggccugaggcagugcacaaguauguuacaccacucuucauuagcagagcucccaauaggaaaaugucagggcagggacauauggaaaccgugaagagugccaagcgccuggaugaggguauauccguacuacgagucccucugacucaacucaaacugaaggaccuugagaaaauggugaacagagaacgggagccaaaguuguacgaagcacugaaagccagguuagaggcucacaaggaugaccccgcgaaagccuuugcagaaccguucuauaaguacgauaaggcuggcaaucgcacccagcagguuaaagccgugcgugucgagcaagugcagaagacagggguaugggugcauaaccacaauggaaucgccgacaacgcuaccauuguuagagucgauguguuugaaaaaggcgguaaguauuaccucgugccuaucuacagcuggcaggucgcaaaagggauucugccagaccgggccguugugcagggcaaggaugaggaggacuggacugugauggaugacucuuucgaauuuaaguucguacuuuaugcgaaugaccugaucaaacuaacagcuaagaaaaacgaguuccucggauacuuugucucacugaauagggccacgggcgcaauagauauccgcacccacgacacugauaguacaaaggggaaaaacggaauuuuccaaagcgugggcguuaagaccgccuuguccuuucagaaguaucagaucgacgaacuggguaaagagauucgacccuguagauuaaagaaacggccucccgugagguga

SEQ ID NO: 2717 - RNA, 3249 nt, Artificial Sequence
  Cas9 variant
auggccgcuuucaagcccaacagcaucaauuacauucugggccucgacauagggaucgcauccgugggaugggccauggucgagauugauaaagaagagaacccuaucagacuuauugaccuggguguuaggguguuugaacgggcggagguaccaaagaccggcgauucuuuggcugccgcacgccgauuagcccguucagugagaaggcugacacggcgcagagcucacaggcuacuccggacucgccgacugcuuaaaagagaagggguccugcaggcagccaauuucgacaagaacggauugaucaaaagucucccgaauacgcuguggcaacugagggcugccgcgcucgaucggaaguuaacuccccuggaguggagcgcagugcuuuugcaucugauaaagcaccguggcuaucuaucccagcgcaaaaacgagggugaaacagccgacaaggagcucggggcucugcuuaaaggaguugccggcaaugcacaugcucugcagacuggcgauuuuagaaccccugccgaauuggcgcucaacaaguucgagaaagagucugggcacaucaggaaucagcggggagacuacucgcauacauuuucacgaaaggaucugcaagccgaauuaaaccuccuguucgagaagcagaaagaauuugguaauccacacauuagcggcgggcuuaaggagggaaucgaaacccuguugaugacucagcgccccgcacuaaguggcgacgcugugcagaaaaugcugggucacugcacauucgagccuaccgagccaaaggccgcuaaaaacacguauacuaccgaaagauuuauuuggcucacaaagcugaauaaccuuaggauccuggagcaaggguccgaacggcccuugacugauaccgagcgcgccacacucauggacgaaccuuacagaaaaucuaagcugaccuaugcacaggccaggaaguuacugagccuagaggauacggcuuucuuuaaaggacuccguuacggcaaggacaaugcggaggcauccacucugauggaaaugaaagccuaucauacaauaucacgggcucuugagaaggaaggcuugaaagacaagaagaguccacugaaccucagcccggagcugcaggaugaaauugggaccgccuucucucuuuuuaaaacugacgaggauaucacaggacgacugaaggacaggauucagcccgagaucuuggaagcacuccugaaacacaucuccuucgauaaguucguccaaauuucauuaaaagcccugagacgcauagugccucuaauggagcaggguaagcgguacgacgaggcuugugccgaaaucuacggcgaucauuaugggaagaaaaacaccgaggaaaagauuuaccucccacccaucccugcagacgagauaagaaauccaguaguucugagggcgcuuagccaggcucgcaaagugauuaacggagucgugcgacgguauggcagucccgcccguauccacaucgaaacggcaagagagguggguaagucuuuuaaagauaggaaggaaauugagaagcgccaagaggaaaaucggaaagacagagagaaggccgcugccaaauucagggaauacuuuccgaacuucgucggggagccuaaguccaaagauaucuugaagcugcgacucuaugaacagcagcacggcaaaugccuguacagcggaaaggagauuaauuuaguucgccugaacgagaagggcuauguggaaauagaccaugcacuucccuuuucgcggaccugggacgauucuuucaauaacaaaguauuggugcucggguccgagaaucagaacaagggaaaucaaacaccauacgaauacuuuaacgguaaagacaauucaagagaguggcaggaguucaaggcuagggucgaaaccagucguuuuccucgcagcaaaaagcagcggauccugcuacagaaguucgaugaggacggcuuuaaagaaagaaaccugaaugauaccagguaugugaaccgauuccucugucaauuuguugccgaccacauucugcuuacagggaagggaaaacggcgcguguucgcguccaacggccagaucacuaauuugcugagagguuucuggggguuaaggaagguccgggccgagaacgaucgacaucacgcucucgacgcagugguaguugccugcucuaccguggcuaugcagcagaaaaucacaagauuuguccgcuacaaggaaaugaaugccuucgauggcaagaccauugacaaagagacuggagaggugcugcaucaaaagacgcacuuuccccagccaugggaguucuuugcacaggaagucaugauaaggguguucggcaaacccgaugggaagccugaauuugaggaagcggacacacuugagaaacugcguaccuugcucgccgagaagcugagcucacggccagaagcuguucacgaguaugugacuccgcuauucguaaguagagcccccaacaggaagauguccggacagggucauauggaaaccgucaaaagcgcaaagcgccuggaugagggcgugucuguucuccgagugccucugacacaacuuaaauugaaggaccuggagaaaauggucaauagagaacgggagccaaaguuauacgaagcucucaaagccaggcuggaggcacacaaggacgaucccgccaaggcuuuugcggaaccuuucuauaaauacgacaaggccgggaaccgcacccaacaggugaaagcaguacguguggagcagguucagaagacuggagucugggugagaaaucauaacggcaucgcugauaaugccacaauggugcgggucgacguuuuugaaaaaggugauaaguauuaccuugugccaauuuacucauggcaaguggccaaggggauccugcccgacagggcuguaguccagggcaaagaugaggaggacuggcagcuaauugaugacaguuucaacuuuaaguucagccuccacccgaaugaucugguggaaguuaucacgaaaaaggcacgcauguucggauauuuugccuccugucaccgaggcaccgggaacauaaauauccggauucaugacuuggaucacaaaaucggaaagaacggcauucuggaggguaucggggugaagacugcguuaucuuuccagaaauaccagauagacgaacucggaaaggagauuagaccuugcaggcugaaaaagcgcccacccgucagauga

SEQ ID NO: 2718 - RNA, 3249 nt, Artificial Sequence
  Cas9 variant
auggccgcuuucaagcccaacccuaucaauuacauucugggccucgacauagggaucgcaagcgugggaugggccauggucgagauugaugaagaggaaaacccaaucagacuuauugaccuggguguuaggguguuugagcgggcggaaguaccgaaaaccggcgauuccuuggcuauggugcgccgauuagcccguucugucagaaggcugacacggcgcagagcacacaggcuacuccgggcccgccgacugcuuaagagagagggggugcugcaggcugcagacuucgaugagaauggauugaucaaaucacuccccaacacuccuuggcaacugagggccgcugcccuggaccggaagcucacgccauuagaauggagugcgguucugcuucauuugauaaaacaccguggcuaucugagccagcgcaagaaugagggugaaaccgcagauaaggagcuaggggcccuccugaaaggaguggcugacaacgcccaugcacuucagacaggcgauuuuagaacucccgcugagcuggccuugaauaaguucgaaaaagaguccggccacaucaggaaccagcgaggggacuacucucauaccuuuucgcggaaggaucuccaagcggaacugauuuuacuguucgagaaacagaaggaauuuggaaauccucacaucucagguggccucaaggaggggauugagacacuucugaugacccagcgcccagccuugagcggagacgcaguccagaaaaugcuaggccacugcacuuucgaacccgcugagccuaaggccgcuaaaaacacauauaccgccgaaagauuuaucuggcugacgaagcucaauaaccugaggauacuugagcaagguagugaacggccacugacugauaccgagcgcgcaacauugauggacgagccguacagaaaauccaagcucacuuaugcccaggcuaggaaacuguuagggcuggaagacaccgcguucuuuaagggacuacguuacggcaaggauaaugcagaggccucuacacucauggaaaugaaggcuuaucaugccauuagccgggcacuggagaaagaaggccuuaaagacaagaaaucccccuugaaccugucaccugagcuccaggaugagaucgggaccgccuucagucuguuuaagacggacgaagauauuacuggacgacuuaaggacagaauccagccagagauccuggaggcuuugcucaaacacauuagcuucgauaaguucgugcaaauaucucugaaagccuuaaggcgcaucguaccccugauggaacaggguaagcgguacgacgaggcaugugcggaaauuuacggcgaucauuaugggaaaaagaauacagaggaaaagaucuaccuaccuccaauacccgcugacgagauuagaaacccgguugugcucagggcccugucccaggcacgcaaagucaucaacggaguggugcgacgguauggcagcccugcccguauccacauugaaaccgcuagagaggucgguaagucauuuaaagauaggaaggagaucgaaaaacgccaagaggaaaaucggaaggacagagagaaggccgcagcuaaauucagggaauacuuucccaacuucguuggggagccaaagaguaaagacauucuuaaguugcgacuguaugagcagcagcacggcaaaugccucuacucuggaaaggaaauaaaucugggccgcuuaaacgagaaaggguauguggaaaucgaucaugcccugccuuuuucccggacuugggacgauagcuucaauaacaagguacuuguguugggaucggagaaucagaacaaggguaaucaaacacccuacgaauacuuuaacggcaaagacaauucuagagaguggcaggaguucaaggcgagggucgaaaccucccguuuuccacgcaguaaaaagcagcggauucuccugcagaaauucgaugaggacggguuuaaggaaagaaaccuaaaugauacgagguaugugaaccgauuccugugucaauuuguugccgaccggaugcgccucaccggaaagggcaaaaagagaguguucgcuucaaauggucagaucacaaaccugcuuaggggguucuggggcuugcggaaaguccgagcagagaacgauagacaccaugcccuggacgcugugguaguugccugcagcacuguggcaaugcagcagaagaucacccgcuuugucagguacaaagagaugaaugcguucgauggaaagacaauugacaaggaaacuggcgagguguuacaccagaaaacccauuuuccccagccuugggaguucuuugcccaggaagucaugauacguguguucgggaagccagauggaaaaccggaauuugaggaggcugacacacccgaaaagcuccggacccugcuugccgagaaacuguccucuagaccugaagcaguucacgaguaugugacuccauuguucguaagcagggcucccaaccgcaagaugucaggucagggccacauggaaacggucaagagugccaaacgacucgacgaggggguguccguucugagagugccucuaacacaacugaagcucaaagaucuggagaagauggucaaucgggaaagggagccaaaacuuuacgaagcauugaaggcccgccuggaggcucauaaagacgaucccgcgaaggccuuugcagaaccguucuauaaguacgacaaagcuggaaaccguacccaacaggugaaggccguaagaguggagcaaguucagaaaacuggcgucugggugcggaaucacaacgguaucgccgauaaugcuaccauggugagggucgacguuuuugagaagggggauaaauauuacuuagugccuauuuacagcuggcaaguggcaaagggcauccucccagaccgcgccguaguccagggaaaggaugaagaggacuggcagcugauugaugacucuuucaacuuuaaauucucacuucaucccaaugaucugguggaaguuaucacaaagaaagcgcgaauguucggcuauuuugcuaguugucacagagggaccggaaacauaaauauccggauucacgaccuagaccauaagaucggcaaaaacgguauucucgaggggaucggagugaagacugcccugagcuuccagaaguaccagauagaugaguugggcaaagaaauuaggccuugccgccugaagaaaagacccccagucagguga

SEQ ID NO: 2719 - RNA, 3249 nt, Artificial Sequence
  Cas9 variant
augagagugcugggccucgacgccgggaucgcuagccuuggaugggcacugauugagauagaagaguccaacaggggugaauugucucagggcaccaucauuggggccggaacauggauguucgaugcgcccgaggaaaagacucaagcuggcgccaaauuaaagucagagcagcggcgcacguuucgaggucagcguagagucguuaggcggcgcagacagaggaugaaugaggugcggcgcauccugcacagucaugggcuacucccuagcuccgaccgagaugcacugaaacaaccaggacuugacccguggagaauuagggccgaagcucuggaucgguugcucggccccguagagcuggcaguggcccugggccacaucgcucgucaucgcggguucaagucuaacucgaaaggagccaagaccaaugacccugcggaugacacaucaaagaugaaaagagcagucaacgaaacuagggagaagcucgcccgguuugguagcgcugccaaaauguuaguggaggaugaaaguuucguucugcgacagaccccaacaaagaauggcgcauccgagauagugcgcagauuuaggaaccgggaaggggacuacucucgcagccuuuugagagaugaccuggcugccgagaugagggcgcuauucaccgcccaggcacguuuucaguccgcuaucgccacugcugaucuccaaacagccuucaccaaagcagccuuuuuccagcggccccugcaggacucagaaaaacuugucggaccuugcccauuugagguggacgagaagcgagcucccaagagaggcuauaguuucgaacuguuuagguucuugagccgccucaaucacguaacgcugcgggaugguaagcaggagagaacuuuaaccagggacgaacuggcgcucgcagccgcugauuucggggccgcagccaaaguuucuuuuacagcccuucgcaagaaacugaaguugccugagacuaccguguucgucggagugaaagcugacgaagaguccaagcuagauguggucgcacgaucaggcaaggcggcugagggcacagcccggcugcguagcguuauuguggacgcacucggggaacuggccuggggagcccuucuguguaguccagagaaauuggauaagaucgcugaaguaauuucuuuuagauccgacaucgguaggauaagcgagggccucgcacaagcugggugcaacgccccgcugguggaugcguuaaccgccgcugcaucggacggacgcuucgaucccuuuacgggcgccggucauauuucuuccaaagcugcccggaauauccugucagggcuaagacagggcaugacuuacgacaaggcauguugcgcggccgacuaugaucacacagcuaguagggaacgaggagccuucgacgucggcgggcacggacgcgaggcacucaaacggauucugcaggaggaaagaaucagcagggagcuuguggguuccccuaccgcucguaaggccuugaucgaaucuauuaagcaaguuaaagcaauaguggagcgcuacggcgucccagaucggauccauguggagcuggccagagacguaggaaagagcauugaagagagggaagagaucacucgagggauagaaaaacggaaccgccagaaggauaaacucagaggccuguuugagaaggagguugguaggcccccucaggacggggcucggggcaaggaagaacuucugcgauucgaauuguggucagagcagaugggaagaugucucuauacagaugacuacauuaguccaucccaacugguggcgaccgaugacgccguccagguggaucacaucuuacccuggagccgcuuugcagacgauucuuaugcuaauaaaacgcugugcauggccaaggccaaccaggacaaaaagggcaggaccccguacgaaugguucaaagcugagaagacagacacugagugggaugcauuuaucguccguguggaagcccuagcggacaugaagggguucaaaaagcggaauuacaaacucagaaacgcugaggaagccgcagccaaguuuaggaaucgcaaccugaacgauacccgaugggcuuguagacuuuuggcagaggcccugaaacagcucuauccuaagggagaaaaagacaaggaugguaaggagcggaggcgcguuuucucacgucccggcgcgcugacagacagauuacggagggcuugggggcugcaauggaugaaaaagaguacuaaaggagaucgcauuccagacgaucgacaucacgcccuugacgcaaucgugauugccgcuaccacagagagcuugcuccagagagccacccgggaaguacaggagauagaagauaagggccugcacuacgaccuagucaaaaaugugacuccucccuggccagguuucagggagcaggcaguugaggcuguggaaaaggucuuuguggcccgcgcggagagaaggcgggcccgugggaaggcacaugaugcuacgauccgccacauugccguacgagaaggcgagcaaagaguguaugaaaggcggaaaguugcugagcugaagcucgcagaccuggaccgcgucaaagaugccgagagaaacgccaggcuuaucgaaaaguugcggaauuggaucgaggcuggaucccccaaagacgauccuccacugucuccgaagggcgaccccauuuucaaggugcgauuagugacaaaaucgaaggucaacauagcgcucgauaccgggaauccuaaaagaccaggaacuguugaccgcggcgaaauggcaaggguggauguguuucggaaggccagcaaaaaggguaaguacgaguauuaccugguacccaucuauccucaugacauugcuaccaugaaaacaccacccauccgugccguccaggcauacaagccggaagaugaguggccugagauggacuccucauacgaguucugcuggagucuugugccaaugaccuaucugcagguuauuucuagcaaaggggagaucuuugaaggauacuauagaggcaugaacagguccgugggugccauacaguugucagcucacagcaauucuuccgaugucgugcaaggcaucggggcgcgcacucucacagaguucaagaaauuuaacguugaccgguucggacgaaagcaugaaguggagagagagcugaggacguggcgcggcgaaaccuggcgggggaaagccuacauuuga

SEQ ID NO: 2720 - RNA, 3255 nt, Artificial Sequence
  Cas9 variant
augaagaacacccuguacggcaucgggcucgacauuggaguggccagcgucgguugggcuguugugggccuuaaugggacaggagagcccguaggccugcacagauugggugugaggauauucgauaaagcagaacagccuaagacuggggaguccuuagccgcgccacggcgcauggcucgaggaaugcguagaaggcugcggcgcaaagcccuaagaagggcagacgucuaugcccuccuggaacggucuggccuuucaacgcgcgaggcucuggcacauauguuugaagccggcggguuggaggauaucuacgcucuccgaaccagagcccuggacgagccggugggaaaggcggaguucaguaggauucugcuccacuuagcacaacggcgugguuuuaaaagcaaccgcagaacagccuccgauggcgaagacgggaggcugcuugcugccguuaaugaaaaccggcgacgcauggcacagggaggcuggagaacugugggugagauguuguauaggcaugaggcuuucgcccugcacaagcggaauaaggcggaugaauaccuaucuaccgucgggcgcgacaugguggccgaggaagcaucgcuccuguuucagagacagagggagcuuggaugcgcuugggccacacccgaacugcaagcugaguauuugucaauccuccugcgucagcggagcuucgaugagggcccuggcgggaacaguccauacggagguaaucagguagagaaaaugguuggccgauguaccuuugaacccgacgaaccuagagccgcaaaggccgcuuauuccuucgaguacuuuucuuuacugcagaaaauuaaccauaucaggcucguggaaaauggggagacucgcccacuuacacaacagcagcggcagcaacuguugagccuagcgcacaagacccccgaugucucccuggcaagaauaaggaaagagcucgcccugccugaaacggugcaguucaacggagugcgcugccgagcuaaugagacucuugaagagucagaaaagaaggagaaauuugccugucugccagcauaccacaagaugcggaaagccuuggacggcgucguuaagggucguaucaguagccucucuauuucccagagagaugcugccgcaaccgcgcugucauuauauaaaaacgaggacacacugagggcuaagcuaacugaagccggguuccaagcaccggagaucgacgcccucgcuggccugaccggauuuagcaaauucggccaucuuaguuugaaggccugccgcaagcugauuccccaccucgaacaggggcugacauacgaucaggcauguucugcugccggauaugacuucaaaggucauggcgcgggggagcgggccuuuacccuuccugcugcagccccagagauggaacagaucacgucccccgugguaagaagggcuguggcccaaacuauaaaggucgugaauggaauuauccgagagauggaugcaagcccugcguggguucgcauugaacuggcccgggaguugucgaaaacauucggcgaaagacaggagauggacaggucuaugcgugagaacgcugcccagaaugaacgccucaugcaggagcugcgggauaccuuucacuuacuguccccaacuggucaagaccuagugaaguacagacucuggaaagaacaggauggggucugcgcauauucacugaggcgacuugacguggagcgguuguucgaacccggcuacguagauguugaccacaucgugccguauagucugagcuuugaugaccgcagauccaacaagguccucgugcugucuagcgagaacaggcagaagggaaaucgguuaccucugcaguaccuucaaggcaaacgaagagaggacuucaucgucuggacaaacucaagugugcgcgauuacaggaagcgucagaauuugcuccgggaaaaacuguccggggacgaggcugaaggauuuagacagaggaaccuacaggauacccaacauauggcccgcuuccuguauaauuacauuagcgaccaccucgcauuugcccagucugaggcucuggguaagaaacgaguuuucgcggugucaggcgccguaacgagucaucuuagaaagcgguggggguugagcaaggucagggcagauggagaccugcaccaugcuuuagaugccgccgugauagcuuguaccacagacggcaugauccgccguauuuccgguuauuacgggcacaucgaaggcgaguaucuccaggaugcagacggagccggcucucaacacgcgagaacuaaagagcgguuucccgcuccauggccuagguuccgcgaugaacugauaguucgacuuucggagcagcccggggaacaucuguuggacauuaacccagaguuuuacugcgaguauggaaccgaacacaucagacccguguucgucagccggaugccuaggcgcaaggugacaggcccaggucauaaagagacuaucaagggggccgcagccgcugaugaaggacuccugaccguaagaaaagcacuaacagagcugaagcucgacaaggacggcgaaauuaaagauuacuacaugccguccucagacacccugcuuuaugaggccuugaaggcgcagcugaggcgguucgguggcgauaguaaaaaggcuuuugccgagcccuucuacaaaccuaaggcagacgggacuccaggacccuuagugcguaaaguuaagacgacagaaaaggccacccucacugucccugugcacggcggggcugccucuaaugauaccauggugcgcgucgacguuuuucuggugccaggagauggcuauuacugggugcccguauauacagcagacacccuuaaaccggagcugccuaaccgagcugucgugcaggguaagccauacagcgaauggaaagagaugagagaagaggauuucaucuuuucccuauaucccaaugaccucguuuacguggagcacaagucagggcugaaauucacuuugcaaaacgccgauagcacacuggaaaagacgaggacccagacuucugcguuugucuacuucgugggaggcuccauuaguacagccagcauaaccauccggacacaugacaaugcauaugguauuccuucuuuaggcguuaagacucucaaaaccuuucacaaguaccagguggauguacuggggaacgucuuccccgugcauaaagagacgcgccagaaguuuagauga

SEQ ID NO: 2721 - RNA, 3255 nt, Artificial Sequence
  Cas9 variant
augaagaacacccuguacggcaucgggcucgacauuggaguggccagcgucgguugggcuguugugggccuuaaugggacaggagagcccguaggccugcacagauugggugugaggauauucgauaaagcagaacagccuaagacuggggaguccuuagccgcgccacggcgcauggcucgaggaaugcguagaaggcugcggcgcaaagcccuaagaagggcagacgucuaugcccuccuggaacggucuggccuuucaacgcgcgaggcucuggcacaaauguuugaagccggcggguuggaggauaucuacgcucuccgaaccagagcccuggacgagccggugggaaaggcggaguucaguaggauucugcuccauuuagcacagcggcgugguuuuaaaagcaaccgcagaacagccuccgauggcgaagacgggaggcugcuugcugccguuaaugaaaaccggcgacgcauggcacagggaggcuggagaacugugggugagauguuguauaggcacgaggcuuucgcccugcauaagcggaauaaggcggaugacuaccuaucuaccgucgggcgcgauaugguggccgaagaggcaucgcuccuguuucagagacaaagggaacuuggaugcgcuugggccacacccgagcugcaggcugaauauuugucaauccuccugcgucagcggagcuucgacgagggcccuggcggggauaguccauacggagguaaccagguagagaaaaugguuggccgauguaccuuugaacccgacgagccuagagccgcaaaggccgcuuauuccuucgaauacuuuucuuuacugcagaaaauuaaucacaucaggcucgcggagaacggggaaacucgcccacuuacacaaccccagcggcagcaacuguugagccuagcacauaagaccccugauaugucccuggccagaauaaggaaagagcucgcucugccagagacggugcaguucaauggaguccgcugccgagccaacgaaacucuugaggaaucagagaagaaggaaaaauuugcaugucugccggccuaccacaagaugcggaaggcuuugggcgguguggugaaagggcguaucaguagccucucuauuucccagagagacgccgcagcgaccgcucugucauuauauaaaaaugaggacacacugagggccaagcuaacugaggcaggcuuccaagcccccgaaaucgaugcucucgccggacugaccggcuuuagcaaauucgggcaccuuaguuugaaggcaugccgcaagcugauuccucaucucgagcagggacugacauacgaccaggcuuguucugccgcggguuaugauuucaaaggccacggggccggagaacgggcuuuuacccuuccagcagccgcucccgagauggagcagaucacguccccugucguuagaagggccguggcacaaacuauaaagguagugaacggcauuauccgagaaauggacgcgagcccagccuggguccgcauugagcuggcucgggaauugucgaaaacauucggugagagacaggaaauggauaggucuaugcgugagaaugccgcaaagaacgagcgccucaugcaggaacugcgggacaccuuucauuuacugucccccacugggcaggaucuagugaaauacagacucuggaaggagcaagacggcguuugcgcuuauucacugcagaggcuugauguggaacaguuguucgagccgggauacgucgacguggaucacaucguaccuuauagucugagcuuugacgaccgacgguccaauaagguucucgugcugucuagcgaaaaccgccagaaaggcaacagauuaccccugcaauaccuucaggggaagaggcgggaggauuucaucgucuggacaaauucaagugugcacgacuaccgaaaaagacagaacuugcuccgcgagaagcuguccgaugacgaagccgagggauuuaggcagcguaaucuacaagauacccagcauauggcacgguuccuguauaacuacauuagcgaccaccucgccuuugcucagucugaagcgcuggguaaaaagagagucuucgccgugucaggcgcaguuacgagucaucuuaggaagcgcuggggguugagcaaagugcgagcugauggagaccugcaccaugccuuagaugccgcuguagucgcauguaccacagacggcaugauaagacggaucuccgguuauuacgggcacauugagggcgaauauuuucaagaugccgacggagcgggcucucagcacgcuaggacuaaggagcgcuucccagccccuuggccccguuuuagagaugagcucaucgugcggcugucggaacagccaggggagccccuucuggacauaaauccugcauucuacugcgaauauggaaccgagcauauuaggccaguuuucgugagccgcaugccgcgaagaaaagucacaggccccucccacaaggagacugugaaaggugccgcugcagccgacgaaggguugcucaccguacggaaggcgcugacagagcuaaagcuggauaaagacggagaaaucaaggauuacuacaugccuucaagugacacccuccuguaugaggcucuuaaagcccaguugaggcgcuuuggcggugauggcaagaaagcauucgccgaaccauuuuacaagcccaaagcugacgggacuccuggaccacuggugagaaagguuaagacgacagagaaagccaccuuaacuguccccgugcauggcggggcagcuucuaacgauaccauggugaggaucgacgucuucuuuaugccgggagauggcuauuacuggguuccucucuauguggccgacacacugaagccagagcuucccaaucgggcggugguagcccacaaaccuuacagcgaauggcaagagaugcgugaagaggauuucgucuuuucccuguaucccaacgaccuaguguacguugaacacaagucagagcucaaauucaccgugcagaaugcagauagcacucuggagaagacacgcacgcaggcuucugccuuugucuacuucguguccggugggauuaguggaggcaccaucacuguucgaacacaugacaacagcuaugguauuccaucuuugggccugaagaccuuaaaaucccucuguaaguaccagguggacguacuggggaaugucuuuccugugcacaaagaaacaagacaaaaguucagguga

SEQ ID NO: 2722 - RNA, 3255 nt, Artificial Sequence
  Cas9 variant
augaagaacacccuguacggcaucgggcucgacauuggaguggccagcgucgguugggcuguugugggccuuaaugggacaggagagcccguaggccugcacagauugggugugaggauauucgauaaagcagaacagccuaagacuggggaguccuuagccgcgccacggcgcauggcucgaggaaugcguagaaggcugcggcgcaaagcccuaagaagggcagacgucuaugcccuccuggaacggucuggccuuucaacgcgcgaggaacuggcucaaauguuugaggcaggcggguuggaggauaucuacgcccuccgaaccagagcucuggacgaaccggugggaaaggccgaguucaguaggauucugcuccauuuagcgcagcggcgugguuuuaaaagcaaccgcagaacagcauccgauggcgaagacgggaggcugcuugccgcuguuaaugagaaccggcgacgcauggcccagggaggcuggagaacugugggugagauguuguauaggcacgaagcauucgcucugcauaagcggaauaaggccgaugacuaccuaucuaccgucgggcgcgauaugguggcggaggaagccucgauccucuuugagagacagagggcaaugggaugcucaugggcugcccccgaacugcaagcugaguaucuuagcauucuguugcgucagcggaguuucgacgagggcccuggcgggaacuccccauacggagguaaucagguagagaaaaugguuggccgauguacauuugaacccgaugaaccuagagccgcaaaggccgcuuauucuuucgaguacuuuagccuccugcagaaauuaaaccacaucaggcuggcggaaaauggggagacccgcccacucacucaaccccagcggcagcagcuucuguccuuggcacauaagacaccugacauaucacuagccagaaucaggaaagagcuggcucucccagaaaccgugcaauucaacggaguccgcugccgagccaaugagacgcuggaagagagugaaaagaaggagaaauuugcaugucuuccggccuaccacaagaugcggaaagcucuggauggcguggugaagggucguauuagcucuuuguccaucucacagagagacgccgcagcgacugcucucagccuguauaaaaacgaggacaccuuaagggccaagcugacagaagcaggguuccaggcccccgagauugaugcucuagccggccucacuggauuuaguaaauucggccaccugucucuuaaggcaugccgcaaguugaucccucaucuggaacaagggcucaccuacgaccaggcuuguacagccgcgggauaugauuucaaaggucacggcgccggggagcgggcuuuuacccugccagcagccgcucccgagauggaacagauaacguccccugucguuagaagggccguggcacagacuauuaagguagugaauggaaucauucgagagauggacgcgagcccagccuggguccgcaucgaacuugcucgggagcugucgaaaacauucggcgaaagacaagagauggauaggucuaugcgugagaacgccgcacagaaugaacgcuugaugcaggagcuccgggacaccuuucaucuguuaucccccacuggucaggaucuggugaaguacagacuauggaaagaacaagacgggguuugcgcuuauucacucaggcgacuggauguggagcggcuuuucgaaccgggcuacgucgacguggaucacaucguaccuuauaguuugagcuuugacgaccgcagauccaacaagguucuggugcucucuagcgagaacaggcagaagggaaaucggcugcccuuacaguaccugcagggcaaacgaagagaggauuucauugucuggacaaacucaagugugcacgacuaccgcaagaggcaaaaucuuuugcgugaaaaacucuccggggaugaggccgaaggauuucggcagagaaaccugcaggacacccagcauauggcaagguuccuauauaauuacauaagcgaucaccuggccuuugcucaaucugaggcgcucgguaagaaacgcgucuucgccgugucaggcgcaguuacgagucaucugcgaaagagaugggggcuuagcaaggugcgggcugacggagauuugcaccaugcccuggacgccgcuguagucgcauguaccacagauggcaugaucaggcgcauuuccgguuauuacgggcacaucgaaggcgaguauuuacaggacgccgauggagcgggcucucagcacgcucguacuaaagagagauuuccagccccuuggccccgguucagggacgaacucauagugcgccugucggagcaaccagcagaaccccuucuggauauuaacccugaguuuuacugcgaguaugggaccgaacauauccgaccaguuuucgugagcagaaugccgcggaggaaggucacaggacccggccacaaagagacuaucaagggugccgcugcagccgacgaaggguugcucaccgugcgcaaagcgcugacagagcuaaagcuggacaaggauggagaaauuaaagacuacuacaugccuuccucagauacccuccuguaugaggcucuuaaggcccaguugagaagguucggcggugacggcaaaaaggcauuugccgagccauucuacaaacccaaggcugaugggacuccuggaccacugguacggaaagugaagacgacagaaaaggccaccuuaacuguucccguccauggcggggcagcuaguaaugacaccauggugcguguggaugucuuucucguuccgggagacggcuauuacugggugccuguguauacagccgauacccugaaaccagagcuucccaaccgcgcgguaguccaggguaagccuuacucugaauggaaagagaugcgagaagaggacuucaucuuuagccuguaucccaaugaucuaguguacguugagcacaaguccgggcucaaauucacucugcagaacgccgacucaacauuggaaaagacgagaacccaaacuagcgcauuugcuuacuucgugucuggauccauuaguacagccagcauaaccaucaggacacacgauaaugcuuauggcauuccaucucugggugucaagacuuuaaaaaccuuucauaaguaccagguggacguucucggcaacguguucccuguacacaaagagacgcggcagaaguuucgcuga

SEQ ID NO: 2723 - RNA, 3255 nt, Artificial Sequence
  Cas9 variant
augagacugggccucgacaucgggaccaacagcauuggaugguggcuuuacgguacagagggcgggaggauaacugaaguggucgauggaggcguucggaucuucuccgacggucgcgauccccagucuaaggccucacuggcuguggaccgacgugcagccagaagucaaaggcggcgcagagauagguauuugcggcgcaaagcggcuuuaaugaagcgaauggcccagguagggcugaugccugcagacccagccgaggcuaaagugcuagaaguccucaauccguacgagcugagagcaagcggacuugauggcccccugccuuugacgcacuuuggcagggcccucuuccaucugaaccagcggcguggguuuaaguccaaucgcaaaaccgacagaggagauaacgaaucugguaagauuaaggacgcuacagccaggcuggaucaggcgaugauggcaaaaggcgcccggacuuauggggaguuccuccacaugcgacgcgcugccgcauuagacccaaagucggugcccucaguuagaaccaggcugacaguggcucggcgcgaugacgccgagaaagaagaggcgggauacgacuuuuauccugauagaaagcaucuuagcgaagaguucgacaaauugugggccgcacaagcuaggcacgccccagauguccugaccgaggaccuacgugaugaaaucgcuacuauuaucuuucaucagcggccccucaagacaccugaggugggccugugccuuuucaccggucagcacgggguaccagaacgagacaagagaauaccgagugcccacccccugaaucagaggcgcaucuugauggagacgguuaacaaucucaaaguggcagcccaaggagaaccuucccggccacugacuagagaggagagggaucagauuguccaugcuuuagacaacaagaaacacaccaagucucugagcggcaugacaaugaaacucaaggcgcuuggcaaagugaucaagcugcgccccgaacagggguuuacuuuggagaccgcaaaucgagaugccauugcuugugacccugugcgggccucccuaucacauccagaucguuucggagcaagauggaguacacuggaaagcgccggucagugggacgucguucaaaggauccgcgcugugcagucugacgccgagcacgcagaucucguaggcuggcugauggacgugcacgggcuugaucgggaccaugcggaagagaccgcuaacgcaccccugccggagggauacggcagauugggucucacggccacuacaaggauacuggccgcuuuagaagccgauguccugaauuauuccgcagcuguggccgcgugcggguggcaccauucagacggccgaaccggagagguucuagaaagccucccuuacuacggcgagauucuggaacgccacgugauccccgggacuggagauccaaacgacgaugacgucaagcgguaugguagaauuacaaauccuaccgugcauaucggccuuaaccaguugaggcgucugguaaaucgcaucauuacgguuuacgggcggcccgaugagauaguggucgagcucgccagagaccugaaacuuagugaagaucaaaagaaagacgugcagagggacaucaagaaaaacaccgaggcugcaauucgacggggaaagaagcuggaagagaugggcgucccaaacacaggugccaaucgcaugguguugagacucugggaggaucugggggacgauguuaugacuaggaacugucccuauaccggcaaacggaucucugcuggaauguuauuugacggcuccugcgauguggaccacauacugccuuacagccgaacacuagaugacucguucgccaauagaacucucugucugaaggaagcaaaccgccagaaaaccgauaagacaccaugggaggcguggggcgaaaccgagcagugggaagccauugcugccaaucuuaaaaacuugccggcaaauaaggcuuggagguuugcccccgacgcaauggagcguuucgagggagaaaaggauuucucugcccgggcucuggcggacacucaauaucucuccagaaucgccagggcauaccuggaugcuuuauaugacggugacgauggcaaaucacacguaugggucgugccugggcgccugacggagaugcuucgaagacauuggggauugaacggcguugccgcccucacagacagugauaagcagaccgugaaagcuaagaaucggacugaccacaggcaucacgcaaucgaugccgcggucguggcugccaccgaccgcggucugauuaaacguaucgcagauauggccaagagagacgaauuuaacggggcugaggaaguagcacggagcauuccacccccuugggagggcuucagggaugacguguccgcccagguuacacgcauaaucgucucucaccgagcggaucauggaagaauugacccagcugcccggaaaagcggcagggacucaaccagugggcagcuacacaaugauacugcauacggaaucggccgcgacgguacagugguguccagaaaaccccuggccagccucucuccgaacgauaucgucguuacgaagaggggagcuaauauucgggacguggaucugcaaaaacaucuugcccgugugacccacggguuggacggcaaggcauuugaggcugcccuguuagcguucgccgcaucaccuauacucccagauaacacugacaaucccuacuuuggucugcgccgaguaagacuugaagagacacugcaggaaagugcuagggucgagguggccgaucaggaaggccggccuuauaaggcuuacaagggggacagcaaccauugcuaugagaucugguguuugcccgauggaaaaauuaagccacagguugugaccacauacgaggcacaccaauccggcgccgaaaagaaaccucaccccgccgcuaagcgccucaugagaaucuucaaaagggacauggucaugcuggagcgggauggggaaacuauuaucggauaugugcagaagaugaaacagaacggcucuauauuuguugcgccacauaccgaggcaaaugccgacgcucgagacagagauccgaaggacgauuucaagcuaauccagcugggugccgggucgcucgugaaagcaaaggcccgcaggguaauugucgacgagaugggacggcugcgugauccugggcccccacuuuga

SEQ ID NO: 2724 - RNA, 3258 nt, Artificial Sequence
  Cas9 variant
auggacaagggcaccaacagcaucgggugggccgcucugagacucgaugagcagggagaacccguggguauuauagaggcaggcgucaggaucuacgccgacgggcgggaaccuaaauccggaacaucucuugcggagggccgccgaauugcucgugguaugucaagaaggcgggaucgcuauaagagaaggcggcgcacuguucugaauacguugaccgaguucggguuaaugccagccacaaaagcagcccgaaaggcucugguggcagaaacuaacgacagaagguuuggagagguagccaguaauguguacgcucuacgggcccgugcgcucgaugaaaaacugccgcuuuaucaacugggccgcgcauuguuccaccucaaccagagaaggggcuuuaagagcaaucggaagaccgacaaacgagauaacgaccaggggaagaucgccuccgcuauuucucgccugggaagaaaacuggaugaggccggugcaaggacacucggcgaguucuuacauaagcagcacgcugccgggaaauggguccgggugcgccccucgagaguuccuggagaagacgauaaggaggaagacggcuacgguuuuuauccagagaggucauuccuggaacgugaguuugcggccaucugggaagcacaagcugccuucuaccccgagcuuuugaccgaggaacggcgagaucaucugcacugggugauguuuuuccagagaccucuaaagaggccaacugucgggaaaugcagcuuucaucccgacgaggaccgccucccuaaggcucacccacuguuccaggaauuucggcuuauaaaagagcugaaugaauuggaggugguacacagaggagauaggcgcgagaagcucacaccggaccagcgagaucggcuguucaaccaauuacguacccagagaaguuccgccuucacggcacugaggaaaacuaucaaggcccccaccggcacacgcuuuaauaaagaaucugacgcucgggauaagcucaagggcgacgagguugcggcagaaaugagccauaaagauagauucgggcaggccuggauuggaaugccucuugcugagaggugggccguggucgcaaugcuguuggacacugaagauccacuagaggugaaggccuggcuggaggaacgauaugguuuugcugccgaccgcaucgaugcaauugcggcugccaaacuccccaccggcuacgggcggcugggagagacagcacuuagagacaugcuggacgaauugaggaacggcaccgugaaggaugacgccggucgugaugucguucucacggagcgccaggcuauggacaauaucuggggcgauaacccugcccugcaacgggcagugacugacgcuagagaguuaccacccuaccaggaaguacuggggaggcgaauaccgccuggaacaggcaaacccgccgauccauaugacgugcagaaggggcggcuaaccaauccuacuguccacauuggacucaaccaacugaagcgcaucgugaauguucuuaugagaaggcauggucggcccgagcagauugcguuggaacuggcccgagaucucaaacugaacgaggaacagaaggcugagaaaaacagagagaucgcacgcaauacaaaggccgcugaagccaggggcaaaaagcuggaggaacuugggcacgcaaacaauggauacaaccguguguugcucaagcugugggaggacuuaaaucugaaacagccagaaaaccgggaguguaucuauugcggcaaggcgauugguauagggacccuacucuccaaucaagucgauaucgaccacauucugcccuggucaaaaacgcuugaugacagucaggccaacagaaucgugugucauguagagugcaauaggcagaagggcaaccacgcuccugccgaaguuccacaguggcaugaccgcuacgaugacauauuggcacgagcugagagacugccgcggaauaaagccuggagguucggacgcgaagcaaugaagaaguuuaaagaugacgagagcuuccucgcccgucaacugaccgauacacaguauuuaucuagacuggcucacgaauaccuuggcgcguuguaucccgacgaggagccugaugaauggggagggccagcccggaggaaccaugugcgcgucauucccggucgaaugacugagaugcucagacggcaguggggccugaaugcaaucaucuccgaccacaaccagaagaauaggaacgaucaccgccaucacgcuauugacgccaucguggucggggugaccacaagaaggcuacugcaacggauugccacuguugcuggaggccgugaagcacucgcccuggaggagaccauagguaaaaucgaaccuccauggcccggguuuuacgaugacgugaaggcggcuauugaucgcaucguagucucacauaaaccggaccacggcagccuuccuaagccaggaaaacccggccgaacagccgggcaguugcacaacgacaccgcauacggauucacuggcgaggccagaaauggugugccuaucaugguucauagggugcccuuugcuagucugacggaaaaggauauuccaucuauacgggaccgccaguuagcagaugcccucuaugcggcuaucuccgggauuagcggaaaggccgagcuggcagccgcucuugccagauucucggaaucuggcccuuacaaagguaucaggcacguccgggugguagagcccguguccguuauugcaaucaaggaccaggcuggcaaagccuauaagggguacaaaggagaugcgaacuaucgauacgacgucugggagcugccaaauggcaaguggacacaugaaguggugucaauguuuaacgcccacagaccggauuggcaaagugagauacgcagcaagaauccugcagcuaggaaagucuugucccuccaucagaacgacaugguugccuaugaacacccccaggauggguacaccaucggacggguggugaaguucucugcuggcggucaaauggcacuggccgggaaucgugagggaggcgcccuaaaaagcagagacgcugauccagaagacagguuucgcuacuucuauaagucagguggcgcgaugcgggacguacagcugcgacaggucagaguggaugagacugggaggguuuucgaccccggaccucaggaucgcgagagucggaacgcaagaaaacaaaaugacgccggcuga

SEQ ID NO: 2725 - RNA, 3264 nt, Artificial Sequence
  Cas9 variant
augagauacaagaucggccuggacauugggauaaccagcgugggaugggccgucaugaaccucgauauccccaggauugaggaccuugguguucggaucuucgaucgcgcugaaaauccucagacaggcgagucccuggcauugccacgacguuuagccagaucugcgaggcggcgccugagaaggcggaaacaccgccuagaacgaauuagaaggcucgugauccgggaggggauacugacuaaggaagaacuugacaaacuguuugaggaaaagcaugagaucgauguauggcaauugcguguggaagcucucgaccgcaaacugaacaaugaugagcuggccagaguccucuuacaccuggcaaagaggcggggauucaagucaaaccgaaaaagugagcgcagcaauaaggaaaacuccacgaugcuuaaacauauugaggaaaauagagccaucuugucuucguauaggaccgugggcgagaugauuguuaaggacccgaaauuugcucugcacaagcggaacaagggugaaaauuacacaaacacuaucgcacgcgaugaccuagagagagagauaaggcucauuuucucaaaacagcgugaauuugggaauaugagcugcaccgaggaguucgagaacgaauauaucacaauuugggccagucagcggcccguggcuuccaaggaugacaucgagaaaaaggucggauuuuguaccuucgagccuaaagaaaagcgagccccaaaagcgacuuacacauuucagucuuucaucgcaugggagcauauuaauaagcugagacuuauaagccccuccggcgccaggggccugaccgaugaggaacgccgguugcucuaugaacaggcuuuucaaaagaacaaaaucacguaccacgacauuagaacucuguuacaucugccugacgauaccuauuucaaggggaucguguacgacaggggagagucacgcaaacagaaugagaacauacgauuucucgaacuugaugccuaccaccagauucggaaggcaguagacaaaguuuaugguaagggcaagaguagcucuuuccugccaaucgauuucgacacauuuggguacgcuuugacucuauucaaagaugacgccgauauccacuccuaucugcguaacgaguacgaacaaaauggaaagagaaugcccaaccucgcgaauaaaguguaugacaacgagcugauugaggaacuucugaauuugucauuuaccaaguucggccaucucagccugaaagccuuaaggaguauccugccuuacauggagcagggugaagucuauucuuccgcaugcgagcgcgcuggguacacauuuaccggaccaaagaagaaacagaagacgaugcuacucccgaacauucccccuauagccaauccaguggugaugcgggcucugacucaggccagaaaagucguuaacgcaaucauuaagaaauacggcagccccgugucgauccacaucgaacuugccagggauuugucucaaacauucgacgagcgacgcaagaccaagaaagagcaggacgaaaaucggaagaaaaacgagacugcuauuagacagcugauggaauauggccucacacugaauccuaccgggcacgauauaguaaaguuuaaacuuugguccgagcaaaacggaaggugugcguacucacugcagccaaucgaaauugagcguuugcucgagcccgguuauguggaagucgaccaugugaucccguacagucgcagccuggaugacuccuauacgaauaagguuuuagugcugacccgggagaacagagaaaaaggcaauaggauuccugcagaguaccuaggggucggaacagaacgauggcagcaguucgagacuuuugugcucaccaacaagcaauucucuaagaaaaagcgggaucgccugcuuagauugcacuaugacgagaacgaagagacagaauuuaaaaauaggaaccugaaugauacucgguacaucagccgauucuuugccaacuucauaagagagcaucucaaguucgcugagucagacgauaaacagaagguauacaccguuaauggccgcgugacagcccaccugaggagucguugggaauuuaacaagaaucgggaggaauccgacuuacaucacgcagucgaugccgugaucgucgcuugcaccacucccagcgacauugccaaagugacggcauucuaucagagaagggagcagaacaaggaacuggcgaaaaagaaagagccacacuuuccucaacccuggccacauuucgcugaugagcuucgcgcccgauugucuaagcaccccaaggaaucaaucaaagcacucaaucuggguaacuacgacgaccagaagcuagagagucugcagccuguuuuugugagcagaaugccaaaacgguccguaacaggggccgcucaucaggaaacccucaggcgcuaugucggcauugaugagcguucuggaaagauccaaacugugguuaaaaccaagcugucggaaauaaaacuugacgccagcggccacuucccgauguacgggaaagaguccgaucccagaacauaugaggcaauucggcagagguugcuggaacacaauaacgacccuaagaaggcuuuucaggagccauuauacaagcccaaaaagaauggagaaccugguccagugauccgcaccgucaaaauuaucgauacuaagaaccaggugauaccccucaaugacggcaagacaguagccuauaacucaaacaucgugcgaguugaugucuucgagaaagacgggaaguacuacugugugccgguguauacgauggauauuaugaaaggaauccugccuaauaaggcgauugaaccaaacaaacccuacagugaguggaaggagaugaccgaagacuauacuuuuagauucucucuuuacccuaaugaucugauccggauagaguugcccagggaaaagacagucaaaaccgccgcuggcgaggagauuaacguuaaggacguguuuguguauuacaaaacaaucgauagcgcaaauggugggcucgaacugaucucccaugaccaccgcuucucacuaagaggcguaggaagcaggacucugaagcgguuugagaaauaucaagucgacgugcucggcaacauuuacaagguucguggggaaaagcgcgugggacuggccucuuccgcucauaguaaaccagguaagaccauccgaccucuucagagcacgagagauuga

SEQ ID NO: 2726 - RNA, 3264 nt, Artificial Sequence
  Cas9 variant
augcugagaaugaaguacgccaucggccucgacauugggauagcuagcgugggauaugcaguccuugcccuggaucacgaggaaaaccccugggguaucauuagguugggcucccggaucuucgacguugcggagaauccuaaagauggggcuucuuuagcccugccacgccgagaagcacguucagugagaaggcggcuacgcagacaucaccauaggcucgagcggauuaagaaccugcuuaucaauaccgaauuuauaacaaaagacgagcuguugcaccucuacgauggaaaccugagugacguauaugagcugcgcgugaaggcccucgauuacagcgucacuaaugcugaauuaacgcgaauccugcuucauuuggcacagagaaggggcuucaaauccaaccggaagucugacgccaaugauaaggaggcuggucaacugcuagaagccgugucggcgaacgcaaaacguaugcaggagaaucacuaucgcaccguuggggagauguuuuacaaggacgaucucuucucaaaauauaagagaaacaaaggaggcacauaccugacuaccgugcacagggacaugauugccgcugaagcccggacaauccuugagaagcaguuugcacugggcaauaacauuugcacccaggauuucaucgacaaguacuugagcauacuccugagucaacgacaguuugacgaagggccgggagagcccuccccuuaugcugguaaucagauugccaacaugaucggcaaauguacuuucgaaccaaaugaguaccgcgcggccaaggcaucuuauagcuuugagagauucaacuuacugcagaaagucaaccaucucaggcuucuguuggaagggaaguccauugcucuagauaaugagcaacggaaaaagaucaucgcccuggcucacgacaaagccgaucuccgcuacucacauauuagaaaggcacugggacuugacgaaaaggugcuguuuaacacaauaaccuauaaugaugacguaaguguuaucgagaaaaagacgaaauucaacuuuuugcaggccuaccaccagauuaagaaagugcucgcugaagauaugcagaagcugacuaccgagcaauuagacaauaucggccagauacugagcacauauaagucugauaacaaaaggacugaggaacuauccgcgcucggucuggagaagaaaauuaucgacgcacuuuuggggaucaauggacugucaaaguucgcccaccucagccugaaagcucugcguaagauuaaccccuaccuugaagagggcaagaucuacaaugaagccugcaccgcagccggcuaugauuucaaagcucaugccaacacacagaagaccgaguugcucccugcauacaaagaggaaauggacgacauuacgaguccagucgcgcggcgagcuauagcccaaucuaucaaggugauuaaugcaaucaucagagagcagaaagggagcccccuguauauuaacauagaauuagccagggagauggcuaagggauuugaugagcgcacucagaucgacaaggccaauaaagaaaaccaggcaaagaaugagcggauuauggaaagaaucaggacagaguuccacaaagcuaacccuaccgguauggaucugauuaagcuaaaacucugggaggaacaagacggccgcuccccauacucgcagaaggccaucucuauaaaccgacuguuugagccgggguauguggauaucgaccauauuguccccuacuccaucucauucgaugacaguuuuaaaaauaagguucuuguguucagcgaugaaaaccgggacaagggaaaucguuugccuauugcguaucugcaguccaaauuuggcgccaaggcugcagagaacuucaugaucuggguacagucuaauauaaaagauuacaagaaaagacaaaagcuccugaagagggaaauuacugaggaagacaucaacaaauuuaaggagcgcaauuuacaggauacaaaaaccauuagccgguuccuguacaacuauaucaaugacuaccuuuuguuugccccaucagacacggguaagaaaaagagagugaccgcugucaacgggacaauaacugccuaucucaggaagcgauggggcaucaauaaaauucgcgcaaacggagauaagcaccaugcgguggacgccguugugaucgcuuguaccacagauaaaaugauuaaggaccugaguuccuucagccgguaccacgagcuagaauauacucacaccgauacagagucuuuucuggucaauucacucaccggcgaaauccugaaaagauuccccuacccuugggaggacuucaggccagaacuuauggcccguuugagugauaaccccgcagacgcucugcgcaaguuaaaucucauauuuuaucaugggauugaucugagcacuaucaagccgaucuucgugucccggaugccuagacacaaaguaacgggagccgcacauaaggccacaauuaaaucugcuaggugccuugacaacgguaucguuauuuguaagaccucgcugcagaacuugaaacucgauaaggagggcgagauagcgaauuacuacgcccccgaaagcgacacuauccuguauaacgcacuaaaagagcgacugcgguccuacgauaauaagccagcuaaggccuuugccgaaccuuucuauaaacccaaggcugacgggaccccaggaccccucgugaaaaaggucaaaguguacgagaagucaacacugaacgucgcagugcagcaaaauaccgccguugcggacaacgauaguauggugcgcguagacgucuuucacgugaagggcaaugguuauuaccuuguuccuauuuauaucgcugauacuuugaaaaaggagcugccaaacaaagccauuguggcauacaagccguacgccgacuggcccgucauggaugacucuaauuucaucuuuagcuuauauccuaacgaucucauaaaauucgaacacaaaaauuccgugaaguuugcuaagguaaacaaggagucaacacugaaugacuucuacagcacgaaaucugaaaucguguauuuuaaggggugcaacauuaauaccggcgcaaucacuauuaucaaccaugagaacacauacguugucuccagucuuggagugaaaacccugccaagccuagaaaaguaucaggccgaugugcucggcaauuacacaaaggucaaaaaggagguuagaaaacccuucagguga

SEQ ID NO: 2727 - RNA, 3264 nt, Artificial Sequence
  Cas9 variant
augagauacaagaucggccuggacauugggauaaccagcgugggaugggccgucaucaaccucgauauucccaggaucgaggaccuugguguucggauuuucgaucgcgcugaaaauccucagacaggcgagucccuggcauugccacgacguuuagccagaucugcgaggcggcgccugagaaggcggaaacaccgccuagaacgaaucagaaggcucauaauccgggaggggauucugacuaaggaagaacuugacaaacuguuugaggaaaagcaugagaucgauguguggcaauugcguguagaagcucucgaccgcaaacugaacaaugaugagcuggccagagugcucuuacaccuggcaaagaggcggggauucaagucaaaccgaaaaagugagcgcagcaauaaggaaaacuccacgaugcuuaaacauauugaggaaaauagagccaucuugucuucguauaggaccgucggcgagaugauagugaaggacccgaaauuugcucugcacaagcggaacaagggugaaaauuacacaaacacuauugcacgcgaugaccuagagagagagaucaggcucauuuucucaaaacagcgugaauuugggaauaugagcugcaccgaggaguucgagaacgaauauaucgccaucugggcuagucagcggcccguugccuccaaggaugacauugagaaaaaggugggauuuuguacauucgagccuaaagaaaagcgagcgccaaaagcaaccuacacuuuucagucuuucauagccugggagcauaucaauaagcugagacuuauuagccccuccggcacaaggggccugaccgaugaagaacgccgguugcucuaugaacaggcuuuucaaaagaacaaaaucacguaccacgacauaagaacucuguuacaucugccugacgauaccuauuucaaggggauugucuacgacaggggagagucacgcaaacagaaugagaacauccgauuucucgaacuugaugccuaccaccagauccggaaggcaguggacaaaguauaugguaagggcaagaguagcucuuuccugccaauugauuucgacacauuuggguacgcuuugacucuauucaaagaugacgccgauauccguuccuaucugagaaacgaguacgaacaaaauggaaagaggaugcccaaccucgcgaauaaaguuuaugacaacgagcugauugaggaacuucugaauuugucauuuaccaaguucggccaccucagccugaaagccuuacgcaguauacugccuuacauggagcagggugaaguguauucuuccgcaugcgagcgggcuggguacacauuuaccggaccaaagaagaaacagaagacgaugcuacucccgaacauucccccuaucgccaauccagucgugaugagagcucugacucaggccaggaaaguggucaacgcaaucaucaagaaauacggcagccccguuucgauucauauagaacuugcccgagauuugucucaaacauucgacgagcgccggaagaccaagaaagagcaggacgaaaauagaaagaaaaacgagacugcuaucaggcagcugauggaauauggccucacacugaauccuaccgggcacgauauugugaaguuuaaacuuugguccgagcaaaacggacguugugcguacucacugcagccaaucgaaauugagcgcuugcucgagcccgguuauacggaaguagaccacgugaucccguacagucggagccuggaugacuccuauaccaauaaggucuuagugcugacaaaagagaacagagaaaagggcaauaggauaccugcagaguaccuagggguuggaacugaacgauggcagcaguucgagaccuuugugcucacaaacaagcaauucucuaaaaagaaacgggaucgccugcuuagauugcauuaugacgagaacgaagagacugaauuuaagaauaggaaccugaaugauacccgguacaucagccgauucuuugccaacuucauuagagagcaccucaaauucgcugagucagacgauaagcagaaggucuacacagugaauggccgcguaaccgcccaucugaggagucguugggaauuuaacaaaaaucgggaggaauccgacuuacaccaugcaguugaugccgugaucgucgcuugcacuacgcccagcgacauugccaaggugacagcauucuaucagagaagggagcagaacaaagaacuggcgaagaaaaccgagccacacuuuccucaacccuggccacacuucgcugaugagcuucgcgcccgauugucuaagcaucccaaggaaucaaucaaagcacucaaucuggguaacuacgacgaccagaagcuagagagucugcagccugucuuugugagcagaaugccaaaacgguccguuacuggggccgcucaccaggaaacccucaggcgcuaugugggcauagaugagcguucuggaaagauucaaacaguagucaaaaccaagcugucggaaaucaaacuugacgccagcggccauuucccgauguacgggaaagaguccgaucccagaacuuaugaggcaauucggcagagguugcuggaacacaauaacgacccuaagaaggcuuuucaggagccauuauacaagcccaaaaagaauggagaaccugguccagugauccgcacaguuaaaauaaucgauacgaagaaccaggugauuccccucaaugacggcaagaccgucgccuauaacucaaacaucgugcgaguagauguguucgagaaagacgggaaguacuacuguguuccggucuauacuauggauauuaugaaaggaauccugccuaauaaggcgauagaaccaaacaaacccuacagugaguggaaggagaugacagaagacuauaccuuuagauucucucuuuacccuaaugaucugauucggaucgaguugcccagggaaaagaucauuaaaacagccggcggugaggagaucaagauuaaagaccucuuugcuuauuacaagacuauacacagcgggaccgcaggccuggagcuagugucccaugauugcucauucagccugucuggagugggcucccgcacgcucaaaagauuugagaaguaucaagucgacguucuggggaacaucuacaaggugaggggagaaaaacgggugggucuugccaguagcgcucacucuaagaccggcgagacaauucguccauugcaguccacucgcgacuga

SEQ ID NO: 2728 - RNA, 3264 nt, Artificial Sequence
  Cas9 variant
augagauacaagaucggccuggacauugggauaaccagcgugggaugggccgucaucaaccucgaucuucccaggauugaggaccuggguguucggaucuucgaucgcgcugaaaauccucagacaggcgaguccuuggcauuaccacgacgucuggccagaucugcgaggcggcgccuaagaaggcggcgccaccgacucgaaagaauuaggcggcugcuuacucgugagaacgugcugacgcaagaagaguuggacaaacucuuugagaagaaacaugaaaucgauguauggcagcugcgcguggaggcucuggacagaaagcucaauaacgaugaauuagccaggguccugcuucacuuggcaaaacggcgaggguucaagucaaaucgcaagagugagagaagcaacaaagaaaauuccaccaugcugaagcauauagaggagaacaggucuauccuaacaggauaucggacugugggcgaaaugauuguucgcgacccgaaauuugugcuccacaagagaaauaaaggugagaacuacaccaauacaaucgccagggaugaccuggaacgugagauucagcuuaucuucgcucggcagcgagaguuugggaacaugauaugcaccgaagcauucgagaaugaauauauugccaucuggucgucacaaagacccgucgcuagcaaggaugacauugagaagaaagugggauuuuguacuuucgaaccuaaggagaaaagggccccaaaggcgacauacaccuuucagaguuucaucgcaugggagcauaucaacaaacugcgcuugguaucccccucuggcacgcgggaacucacugaugaggaaagaaggcuguuauaugagcaggccuuucagaagaauaaacugaccuaccacgacauucgcacacuccuucaccuuccugacgauacuuauuucaagggcauaguuuacgacuggggagaaccauugaagcaaaacgagaacauccgauuucuagagcuggaugcuuaccaucagauucggaaaaccguggacaaggucuaugggcgugguaaaagcuccucauuccuccccaucgauuucgacacauuuggcuacgcccugacccuuuucaaggaugacgcacacauaagaaguuaucugaggaaugaauacgagcagaacgggaaacgcauugcuaauuuggccaacaagguguaugauaaugaacucaucgaggagcuguuaaaccugagcuuuacgaaguucggacaucuaucucucaaagcgcugcggaauauccuuccuuacauggaacagggcgagguguauuccucagccugcgaaagagcagguuacacuuuuacagggccaaccaagaaacaaaagacugucuugcugccgacaauucccccuaucgcuaacccaguugugaugagggcccucacccaggcucgaaaaguagugaaugccauuauaaagaaguacggaagccccgucaguauccacauugagcuggcacgcgaccuuucucagacguucgaugaacggaaaaagaccaaaaaggagcaagacgagaacagaaaaaggaaugaaacagccauccgucagcugaucgaguauggcuugacucgcaacccuaccggccacgacauugugaaguuuaagcucugguccgaacagaaugggcggugugcuuacagccugcagccaauagagaucaaaagauuacuggaacccggauauguugagguggaucaugucauuccguacucgaggucucuagacgauuccuauacaaacaaggugcucguacugacuaaagagaaucgagaaaaggguaaccggaucccugcggaguaccuuggcguugggaccgaacgcuggcaacaguucgagacauuuguguugaccaacaaacaguucucaaagaaaaagagagacaggcugcuccggcugcacuaugaugaaaaugaggaggcagaauggaagaaccgaaguuuaaaugacacuagauacauuagccgcuuuuucgccaacuuuaucagggagcaucugaaauucgcugauuccgacgauaagcagaaagucuacacggugaauggaggcgucacagcccaccuucguucucggugggacuucaacaagaauagagaagagagcgauuugcaucacgcaguggacgccgcuauaguugccugcaccacucucucagauaucgcaagggugaccgcguuuuaucaacgccgagagcaggcuaaagaacuggccaagaagacagagccccacuucccacagccuuggccccauuuugcagacgaacuaagagcccggcugaguaaaaacccaaaggaguccauuaaagcucucaaucuggguaacuacgacaaugaaaagcuggagagcuugcagcccguauucgucucuaggaugccuaaacgcucagugaccggggccgcacaccaagagacucugcguagauauaucggcauugaugaacggaguggaaagauccagacaguugugaagacgaaauuaagcgagauaaagcucgacgcuuccggccauuuuccaauguacgggaaagaaucugauccgaggaccuaugaggccauucgccugcgacuucuggaacacaacaaugaccccagaaaggcguuccaggagccuuuguacaaaccaaagaagaacggagagcucggucccaucauucggacugucaaaaucauagauacaaagaaucaggugaucccucugaacgacggcaaaaccguagccuauaacucgaauauugugaggguugaugucuuugaaaaggacgggaaauacuacugugugccaguguauacaauggauaucaugaagaaaguccuacccaacaaggcuauugagccgaauaagccuuacagcgaauggaaagagaugacugaagacuauaccuuccgcuuuucccuguacccaaacgaucucaucagaauagagcugcccagggagaagacgguuaaaaccacagcaggacacgaaauuaauaucaaggacguguucguguauuacaaaacuaucgauucagccaccggcggucuugaguugauuagucaugacaacucuuuuagccugcgggggaucggcucccguacauuaaagcgcuucgaaaaguaucaaguagacguccucggaaauauuuacaaagugcgaggcgagaagagaguugggcuggcuucaagcgcccacccugagacuagggaaaccauacggccccuucagucuacgcgcgauuga

SEQ ID NO: 2729 - RNA, 3264 nt, Artificial Sequence
  Cas9 variant
augaagaaacuggugcucggccuugacaucggggucgccagcguuggaugggguauuauagaugcugagaacggcgacgugguagauaccggggugagacuguucuccucuagggacgcaucagaaaaugagagucggcgcacaagccgacagucccguagauugucuaggcggaagaaacaccgcagagaaaggaucaagcaauuacugcuagcccaugauauggacauuugcgauaucgucaacgagaaucccuacgaacuccgggugaaaggacugaacgagaaacuugagguuucggaaauuuauguggcgcugacucacuuggcuaagcgccgaggcgucucauaccucgacgaugugguagaggaaggugggacgaucaaaagcgagcaucugaauaagaacauggaggaaauaaaaaguggaaagaugccuugugagauccagcuggaaagauuugagaaauauggccagguuaggggcaugauugaaaucaaucaggacaccgaggaguccucuuuccucgugaacauuuuucggacaagcgauuacaucaaggaagccaagacuauauuagcaacccaacagaaauuccacaagcagauuacaaaugaguuuaucgacgaauauauucauaucauggccuccaaacgugauuacuucaucgggccaggaaacgagaagucacgcaccgacuauggugucuacagaacuaauggcgacacaugggauaaccuguuugaaauucuuauagggaaaugcaguguguucccggaggagaccagggcugcacggagcucuuacguggcccaggaauuuaauuugcugaacgaccuaaauaaccucaagaucuccaaccuggagucaggaaaacuuagcgcuagucaaaagcacgauauugucgaaaagguuaaaaauucuaagaaauucggcacgaaggaccuguugaaauauaucgccuccgugugugagugcaagauagaagauauuggugggugucgaguagacaagaaccgcaaacccaucaugcacacuuuugagaauuacagaaaggugcauaacgcgcucaaugaggcaggagucgaucugagguuaagcgaaaccgacuaugaugagcugaugaaaaucaugacacucaacucggaaacucuugagauuaagaaacagugcaaggagaagcugccucaguugaccgaagacuaccuaaaugugugucugguucucaacaaaaagggcgccuucucuggcuggcacgcucugucccuuaaagccaugaagcugaugaugccagaguuguaugggacaucaaagaaucagaugcaaaucauucauaccaugcagcucggaaaggcauaccugaagcccuuaaaccagcaaaaauaucugaauagugaagcuauacuagaggaaaucuacaacccuauugccgcgcggagcauccgccagacgaucaaggugacuaaugccauucucaaaaaguacggucaccuggauuccgucauaaucgagaugccaagagacuaucagacaucugaggacgaaaggaaaaugauugagaagaugcagaaagaaaacgagaaggaaaagaaagcagcucuuaagcgugcccgggaggaguaccccuuuccugaugaagcauuccgaaaucacaaagaguuggccaccaagcugagacucugguaucaacaggaccaguucugcguguacagcggcaggaaaaucucaguaguugaucuggugcgcaacccaaaccaguuugaaauugaccauaucauaccgcaaagugucucccuugaugacagccugaauaacaagguguuguguuucucugaggaaaaucagaagaaagggcagcagacucccuuuuauuaccacaagggaaaaucaggcaacuggacauaugagcaauacaaacucuucgucgagaaacuguuugauaagaagaaaaucaguaauaagaaacgggaauuacugcuauucgaggaagacauuaacaagugggaugugagaagggguuuuaucgcacgcaaucucguugacacccgauacgccagccgggugauucugaacuccuaucagcaguacuucgggaaucaugagaugggcacgaaaguaaaggucgugcguggaaaguuuaccucucagcuuagaaagaaguggaggaucuucaaagaucgcaacgagucgcacagccaucacgcuauagacgcguugauuguugcagccacagcuaaucugcggcucuggaagaaaaacacucugggcguguccgaugaagggaaggucuaugacaaagagaccggagaaaucuuaccuuuugagaagcugacagaaucagaguacaaugagaugaugaacaaggaaccauaucuuaauuucaaaacuaaguugcaaaacauugagaccaaagugaaguacaguuauagaguaucuaaaaaggugaacaggaagaucagcgacgccacaauauacuccacccgagaacgcgaugguaucgacuacauuguuggcaaaaucaagaauauuuaugaugucaaaacuuacaaggaccaguuucucaaacgguauaagaagaacaaagagcaguuccugauguaccaacacgauccccagacguucgcaauccuagaaaauauaauggccacauaucaggacgcugagaacccuuuucuggccuacaagaaagaguauggggugauuagaaaguacagcaaaaagggaggcgguucaccagugaccucucucaaguucaucgauaaaguccuggggcagaagaucgaccuuacugcuaaaaaucaagcggcuuugcccaagaacaaaaagguugugcugcaguccauuaccccguacagggccgauguguauuacgacgaaaucgauaagcguuaucauuuaauuggcguaaaauacagucucuuuagcuucucuaagcagggauaugucauaaauccuaucgcauaccagaaacugcuugagaaggaacaaauucacuccgagaugaaauuuugcuucucacuguaucgcgaagacaucauugaguuuggcgaggaucccgacaguuugacacgguacagauucuggagcaagaacgaaucggggaaaaauaagaucgaggugaagccaauagaaaaaccuaacuuugagaagcagaccguucucacuaucacgaaaaagauuaaaauccugaauaaguaccagacagacgugcuaggaaacuccuucaaggcccaggaggaaaaagaucccaggaauauugaguga

SEQ ID NO: 2730 - RNA, 3264 nt, Artificial Sequence
  Cas9 variant
augagauacaagaucggccuggacauugggauaaccagcgugggaugggccgucaugaaccucgauauccccaggauugaggaccuugguguucggaucuucgaucgcgcugaaaauccucagacaggcgagucccuggcauugccacgacguuuagccagaucugcgaggcggcgccugagaaggcggaaacaccgccuagaacgaauuagaaggcucgugauccgggaggggauacugacuaaggaagaacuugacaaacuguuugaggaaaagcaugagaucgauguauggcaauugcguguggaagcucucgaccgcaaacugaacaaugaugagcuggccagaguccucuuacaccuggcaaagaggcggggauucaagucaaaccgaaaaagugagcgcagcaauaaggaaaacuccacgaugcuuaaacauauugaggaaaauagagccaucuugucuucguauaggaccgugggcgagaugauuguuaaggacccgaaauuugcucugcacaagcggaacaagggugaaaauuacacaaacacuaucgcacgcgaugaccuagagagagagauaaggcucauuuucucaaaacagcgugaauuugggaauaugagcugcaccgaggaguucgagaacgaauauaucacaauuugggccagucagcggcccguggcuuccaaggaugacaucgagaaaaaggucggauuuuguaccuucgagccuaaagaaaagcgagccccaaaagcgacuuacacauuucagucuuucaucgcaugggagcauauuaauaagcugagacuuauaagccccuccggcgccaggggccugaccgaugaggaacgccgguugcucuaugaacaggcuuuucaaaagaacaaaaucacguaccacgacauuagaacucuguuacaucugccugacgauaccuauuucaaggggaucguguacgacaggggagagucacgcaaacagaaugagaacauacgauuucucgaacuugaugccuaccaccagauucggaaggcaguagacaaaguuuaugguaagggcaagaguagcucuuuccugccaaucgauuucgacacauuuggguacgcuuugacucuauucaaagaugacgccgauauccacuccuaucugcguaacgaguacgaacaaaauggaaagagaaugcccaaccucgcgaauaaaguguaugacaacgagcugauugaggaacuucugaauuugucauuuaccaaguucggccaucucagccugaaagccuuaaggaguauccugccuuacauggagcagggugaagucuauucuuccgcaugcgagcgcgcuggguacacauuuaccggaccaaagaagaaacagaagacgaugcuacucccgaacauucccccuauagccaauccaguggugaugcgggcucugacucaggccagaaaagucguuaacgcaaucauuaagaaauacggcagccccgugucgauccacaucgaacuugccagggauuugucucaaacauucgacgagcgacgcaagaccaagaaagagcaggacgaaaaucggaagaaaaacgagacugcuauuagacagcugauggaauauggccucacacugaauccuaccgggcacgauauaguaaaguuuaaacuuugguccgagcaaaacggaaggugugcguacucacugcagccaaucgaaauugagcguuugcucgagcccgguuauguggaagucgaccaugugaucccguacagucgcagccuggaugacuccuauacgaauaagguuuuagugcugacccgggagaacagagaaaaaggcaauaggauuccugcagaguaccuaggggucggaacagaacgauggcagcaguucgagacuuuugugcucaccaacaagcaauucucuaagaaaaagcgggaucgccugcuuagauugcacuaugacgagaacgaagagacagaauuuaaaaauaggaaccugaaugauacucgguacaucagccgauucuuugccaacuucauaagagagcaucucaaguucgcugagucagacgauaaacagaagguauacaccguuaauggccgcgugacagcccaccugaggagucguugggaauuuaacaagaaucgggaggaauccgacuuacaucacgcagucgaugccgcuaucguggccugcaccacucccagcgacauugcaaaagucacggcguucuaucagagaagggagcagaacaaggaacuggcuaaaaagacagagccacacuuuccucaacccuggccacauuucgccgaugagcuucgcgcacgauugucuaaacaccccaaggaaucaaucaaggcccucaaucuggguaacuacgacgaccagaaacuagagagucugcagccuguguuuguuagcagaaugccaaagcgguccgugaccggggcugcccaucaggaaacucucaggcgcuauguaggcauugaugagcguucuggaaaaauccaaaccgucgugaagacaaaacugucggaaauaaaacuugacgcaagcggccacuucccgauguacgggaaggaguccgaucccagaaccuaugaggcuauucggcagagguugcuggaacacaauaacgacccuaaaaaggccuuucaggagccauuauacaaacccaagaaaaauggagaaccugguccaguuauccgcacugugaagauuaucgauacaaagaaccaggucauaccccucaaugacggcaagacgguggcguauaacucaaacaucguacgaguggauguuuucgagaaggacgggaaauacuacugugucccgguguauaccauggauauuaugaagggaauccugccuaauaaagccauugaaccaaacaagcccuacagugaguggaaagagaugacugaagacuauacauuuagauucucucuuuacccuaaugaucugauccggauagaguugcccagggaaaagaccgugaagacagcugcaggcgaggagauuaacgucaaagacguuuuuguguauuacaagacuaucgauagcgccaauggugggcucgaacugaucucccaugaccaccgcuucucacuaagaggcgugggaagcaggacccugaaacgguuugagaaguaucaaguagacguccucggcaacauuuacaaagugcguggggaaaagcgcguuggacuggcuucuuccgcccauaguaagacgggugagaccgugcgaccacuucagagcacaagagauuga

SEQ ID NO: 2731 - RNA, 3264 nt, Artificial Sequence
  Cas9 variant
augagauacaagaucggccuggacauugggauaaccagcgugggaugggccgucaugaaccucgauauccccaggauugaggaccuugguguucggaucuucgaucgcgcugaaaauccucagacaggcgagucccuggcauugccacgacguuuagccagaucugcgaggcggcgccugagaaggcggaaacaccgccuagaacgaauuagaaggcucgugauccgggaggggauacugacuaaggaagaacuugacaaacuguuugaggaaaagcaugagaucgauguauggcaauugcguguggaagcucucgaccgcaaacugaacaaugaugagcuggccagaguccucuuacaccuggcaaagaggcggggauucaagucaaaccgaaaaagugagcgcagcaauaaggaaaacuccacgaugcuuaaacauauugaggaaaauagagccaucuugucuucguauaggaccgugggcgagaugauuguuaaggacccgaaauuugcucugcacaagcggaacaagggugaaaauuacacaaacacuaucgcacgcgaugaccuagagagagagauaaggcucauuuucucaaaacagcgugaauuugggaauaugagcugcaccgaggaguucgagaacgaauauaucacaauuugggccagucagcggcccguggcuuccaaggaugacaucgagaaaaaggucggauuuuguaccuucgagccuaaagaaaagcgagccccaaaagcgacuuacacauuucagucuuucaucgcaugggagcauauuaauaagcugagacuuauaagccccuccggcgccaggggccugaccgaugaggaacgccgguugcucuaugaacaggcuuuucaaaagaacaaaaucacguaccacgacauuagaacucuguuacaucugccugacgauaccuauuucaaggggaucguguacgacaggggagagucacgcaaacagaaugagaacauacgauuucucgaacuugaugccuaccaccagauucggaaggcaguagacaaaguuuaugguaagggcaagaguagcucuuuccugccaaucgauuucgacacauuuggguacgcuuugacucuauucaaagaugacgccgauauccacuccuaucugcguaacgaguacgaacaaaauggaaagagaaugcccaaccucgcgaauaaaguguaugacaacgagcugauugaggaacuucugaauuugucauuuaccaaguucggccaucucagccugaaagccuuaaggaguauccugccuuacauggagcagggugaagucuauucuuccgcaugcgagcgcgcuggguacacauuuaccggaccaaagaagaaacagaagacgaugcuacucccgaacauucccccuauagccaauccaguggugaugcgggcucugacucaggccagaaaagucguuaacgcaaucauuaagaaauacggcagccccgugucgauccacaucgaacuugccagggauuugucucaaacauucgacgagcgacgcaagaccaagaaagagcaggacgaaaaucggaagaaaaacgagacugcuauuagacagcugauggaauauggccucacacugaauccuaccgggcacgauauaguaaaguuuaaacuuugguccgagcaaaacggaaggugugcguacucacugcagccaaucgaaauugagcguuugcucgagcccgguuauguggaagucgaccaugugaucccguacagucgcagccuggaugacuccuauacgaauaagguuuuagugcugacccgggagaacagagaaaaaggcaauaggauuccugcagaguaccuaggggucggaacagaacgauggcagcaguucgagacuuuugugcucaccaacaagcaauucucuaagaaaaagcgggaucgccugcuuagauugcacuaugacgagaacgaagagacagaauuuaaaaauaggaaccugaaugauacucgguacaucagccgauucuuugccaacuucauaagagagcaucucaaguucgcugagucagacgauaaacagaagguauacaccguuaauggccgcgugacagcccaccugaggagucguugggaauuuaacaagaaucgggaggaauccgacuuacaucacgcagucgaugccgugaucgucgcuugcaccacucccagcgacauugccaaagugacggcauucuaucagagaagggagcagaacaaggaacuggcgaaaaagacagagccacacuuuccucaacccuggccacauuucgcugaugagcuucgcgcccgauugucuaaacaccccaaggaaucaaucaaggcacucaaucuggguaacuacgacgaccagaaacuagagagucugcagccuguuuuugugagcagaaugccaaagcgguccguaaccggggccgcucaucaggaaacucucaggcgcuaugucggcauugaugagcguucuggaaaaauccaaaccgugguuaagacaaaacugucggaaauaaaacuugacgccagcggccacuucccgauguacgggaaggaguccgaucccagaaccuaugaggcaauucggcagagguugcuggaacacaauaacgacccuaaaaaggcuuuucaggagccauuauacaaacccaagaaaaauggagaaccugguccagugauccgcacugucaagauuaucgauacaaagaaccaggugauaccccucaaugacggcaagacgguagccuauaacucaaacaucgugcgaguugaugucuucgagaaggacgggaaauacuacugugugccgguguauaccauggauauuaugaagggaauccugccuaauaaagcgauugaaccaaacaagcccuacagugaguggaaagagaugacugaagacuauacauuuagauucucucuuuacccuaaugaucugauccggauagaguugcccagggaaaagaccgucaagacagccgcuggcgaggagauuaacguuaaagacguguuuguguauuacaagacuaucgauagcgcaaauggugggcucgaacugaucucccaugaccaccgcuucucacuaagaggcguaggaagcaggacccugaaacgguuugagaaguaucaagucgacgugcucggcaacauuuacaaaguucguggggaaaagcgcgugggacuggccucuuccgcucauaguaagccagguaaaacgauccgaccucuucagagcaccagagauuga

SEQ ID NO: 2732 - RNA, 3264 nt, Artificial Sequence
  Cas9 variant
augagauacaagaucggccuggacauugggauaaccagcgugggaugggccgucaucaaccucgauauucccaggaucgaggaccuugguguucggauuuucgaucgcgcugaaaauccucagacaggcgagucccuggcauugccacgacguuuagccagaucugcgaggcggcgccugagaaggcggaaacaccgccuagaacgaaucagaaggcucauaauccgggaggggauucugacuaaggaggaacuugacaaacuguuugaggaaaagcaugagaucgauguguggcaauugcguguagaagcucucgaccgcaaacugaacaaugaugagcuggccagagugcucuuacaccuggcaaagaggcggggauucaagucaaaccgaaaaagugagcgcagcaauaaggaaaacuccacgaugcuuaaacauauugaggaaaauagagccaucuugucuggcuauaggaccgucggugagaugauagugaaggacccgaaauuugcucugcacaagcggaacaagggggaaaauuacacaaacacuauugcacgcgaugaccuagagcaugagaucagacucauuuucucgaaacagagggaauuuggaaauaugucaugcaccgagaaguucgaaaacgaguauaucacaaucugggccagccagcgucccguugcuaguaaagaugacauugaaaagaaagugggcuuuuguaccuucgagccuaaggagaaacgggccccaaaggcgacuuacacauuucaguccuucauagcaugggaacacaucaauaagcugcgacuuauuuuucccucuggcgccagagggcugaccgaugaggaaaggcgcuugcucuaugagcaagccuuccagaaaaacaagaucacguaccacgacauacggacucuguuacaucugccugacgauaccuauuuuaaaggaauugucuacgacagaggugaaagcaggaagcagaaugagaacauccgcuuccucgagcuugaugcuuaccaccagauccgaaaagcaguggacaagguauauggcaaggggaaauccucaaguuuccugccaauugauuuugacacauucggauacgcuuugacucuauuuaaggaugacgccgauauccauagcuaucugcggaacgaauacgagcaaaauggcaaacguaugcccaaccucgcgaauaagguuuaugacaacgaacugauugaggagcuucugaauuugucuuucaccaaauuuggucaccucucccugaaggccuuaagaucaauacugccuuacauggaacagggggagguguauagcagugcaugcgaaagggcuggauacacauucaccggcccaaagaaaaagcagaaaacgaugcuacucccgaacauucccccuaucgccaauccagucgugaugcgcgcucugacucaggcccggaagguggucaacgcaaucaucaaaaaguacggcucucccguuuccauucacauagagcuugccagagauuugagccaaacauuugacgaaaggcgaaagaccaaaaaggagcaggacgagaaucgcaaaaagaacgaaacugcuauccggcagcugauggaguaugggcucacacugaauccuaccggacaugauauugugaaauucaaacuuuggucggaacaaaacgguagaugugcguacucucugcagccaaucgagauugaaagguugcucgagcccggcuauguagagguggaccacgucaucccguacucccguucacuggaugacaguuauacgaauaaaguguuaguucugacccgcgaaaaccgggagaaggggaauagaauaccugcagaauaccuaggagugggcacagagagguggcagcaguuugaaacuuucguccucaccaacaagcaauuuagcaaaaagaaacgagaucggcugcuucgcuugcauuaugacgagaacgaggaaacagaguucaagaauagaaaccugaaugauacuagguacaucucccgguuuuucgccaacuucauucgagaacaccucaaauuugcugagucugacgauaagcagaagguguacaccguaaaugguagaguuacaagccaucugcgcucaaggugggacuucaacaaaaaucgugaggaaagugauuuacaccacgccguggacgcagccaucgucgcuugcaccacucccuccgauauugccaaggugacggcauuuuaucagcggagagagcagaacaaagaacuggcgaagaaaacagagccacauuucccucaacccuggccacacuuugcugacgaacuuagggcccgcuugagcaagcaucccaaggagucuaucaaagcacucaaucuggggaacuacgacgaucagaagcuagagucacugcagccugucuucgugagucgaaugccaaaaagaagcguuaccggcgccgcucaccaggaaacucuccggagguauauaggaauugacgagcgcuccggcaagauccaaaccgugguaaaaacaaagcugucugaaauuaaacuugaugccucggggcacuuuccgauguacggaaaggagagcgacccccguaccuaugaagcaaucagacagcgguugcuggagcauaauaacgauccuaagaaggcuuuccaggagccauuauacaagcccaaaaagaauggugaaccuggcccaauaaucaggacugucaaaauuaucgacacaaagaaccaggugauuccccucaaugaugggaagacgguugccuauaacuccaacaucgugcgcgucgacguguuugagaaagauggaaaguacuacuguguaccgguguauaccauggacauaaugaaaggcauucugccuaauaaggcgaucgaaccaaacaaacccuacucagaguggaaggaaaugacugaggauuauacauuccgauuuagucuuuacccuaaugaccugaucagaauugaguugccccgggaaaagaccguuaaaacaacuaccggugaggaaaucaacgucaaggauguguucguguauuacaaaacgauugacucugccaccgggggccucgagcugauaagccacgacaauagguuuucccuacgcggagucggcucaagaacacugaagagguucgagaaauaucaaguugaugugcucgggaacaucuacaaggugcggggagaaaagcguguaggucuggcuagcucugcacauuccaaaacuggcgagaccauucgcccacuucagaguacacgagacuga

SEQ ID NO: 2733 - RNA, 3264 nt, Artificial Sequence
  Cas9 variant
augagauacaagaucggccuggacauugggauaaccagcgugggaugggccgucaucaaccucgauauucccaggaucgaggaccuugguguucggauuuucgaucgcgcugaaaauccucagacaggcgagucccuggcauugccacgacguuuagccagaucugcgaggcggcgccugagaaggcggaaacaccgccuagaacgaaucagaaggcuccugauacgggagggggugcuuacuaaggaagaacuggacaaauuguuugaggaaaagcaugagaucgauguauggcaacuccguguggaagcucuggaccgcaaacugaacaaugaugagcucgucagaguguuacugcaccuugccaagaggcggggauucaagucaaaccgacagagugagcgcagcaauaaagaaaacuccacgauguugaagcauauugaggaaaauagagcaauccugucuggcuauaggaccguuggugagaugauugugaaagacccgaaguuugcccuacacaaacggaacaagggggaaaauuacacaaacacuaucgcucgcgaugaccucgagagagagauaaggcugauuuucucgaagcagcgugaauuuggaaauaugucaugcaccgaggaguucgagaacgaauauaucgcaauuugggccagccagcggcccgucgcuaguaaagaugacaucgagaagaaagugggcuuuuguacauucgagccuaaggaaaaacgagccccaaaggcgaccuacacuuuucaauccuucaucgcaugggagcauauuaauaaacuuagacugauaucucccagcggcacaaggggguugaccgaugaggaacgccggcuccuguaugaacaggccuuucagaagaacaagaucacguaccacgacauuagaacuuuacugcaccucccugacgauaccuauuucaaaggaaucguauacgacuggggugagucccuuaagcagaaugagaacauaagguuucuggaauuggaugcuuaccaucaaauucgcaaagccaucgacaagguuuauggcaaagggaagucaaguagcuuccuaccaaucgauuucgacacauuuggauacgcacugacucucuucaaggaugacgcugauauucgaucuuaucugcggaacgaguacgaacagaauggcaaacguaucgccaaccuugcgaauaagguguaugacaacgagcugauugaggaauugcucaaucuguccuuuaccaaauucggucacuuaucacugaaggcccuaagaaacauacuccccuacauggagcagggggaagucuauagcagugcaugcgagaaagcuggauacacauuuaccggcccuaagaagaaacagaagacggugcugcuuccaacuaucccgcccauugugaauccugucguuaugagggccuugacacaagcucgcaaagugguaaacgccaucaucaagaaauacggcucuccaguguccauucauauagaacuggcacgggaucucagccagaccuucgacgagagaaggaagacuaagcgagagcaggacgaaaaucgcaaacggaacgagacagccaucagacaacugauggaauaugggcuuacccugaaucccacgggauuggauauugucaaguuuaaacucuggucggagcagaacgguaggugugcuuacucucugcagccuaucgaaauugagcguuuacuggagccaggcuauguggaaguugaccacgugauccccuacucccgcucacuagaugacaguuauaccaauaagguccucgugcugacaaaagagaaccgggaaaaggggaauagaauaccggcggaguaccuuggaguaggcacugaaagguggcagcaauucgagaccuuuguuuugacaaacaaacaguucagcaagaagaaacgagaucggcugcuccgccugcacuaugacgagaacgaagagauggaauuuaaguccagaaauuuaaacgauacuagguacaucucucgguucuuugcaaauuucauucgagagcaucugaaauucgccgagagcgacgauaagcagaaaguguacaccgucaacgguagagugacaucacaccuucgcaguaggugggacuuuaauaagaaccgugaagaguccgauuugcaucacgcugucgacgccgcaaucguggccugcaccacuccuagcgauauugcuaagguuacggccuucuaucagcggagagaacaaaauaaagagcucgcaaagaaaacagaaccccaguuuccacagccuuggccccauuucgcggacgagcugagggcucgccuaucuaagcacccaaaagagucaaucaaggcccugaaccucgggaauuacgacgaucagaagcuggaaagucuucaacccguguuuguaagccgaaugccuaaaagauccgucaccggcgcagcccaccaggagacuuugcggagguauauaggaauugacgaacgcucuggcaagauccagaccgugguuaaaacaaagcugucggagauuaaauuagaugcuagcgggcauuucccaauguacggaaaggaauccgacccgcguaccuaugaggccaucagacagcggcuccuggagcacaacaaugaucccaagaaagcauuucaagaaccucuuuacaagcccaaaaagaacggugagccaggcccuauaaucaggacugugaaaauuaucgacacaaagaaucaggucauuccacugaacgaugggaaaacgguggcuuauaauucaaacaucguacgcauagacguguucgaaaaggauggaaaguacuacuguguucccgucuauaccauggacauuaugaaaggcguguugccgaacaaggccaucgagccuaauaaaccauacagugaauggaaggagaugacugaggauuauacauuucgauucucucucuaccccaacgaccugaucagaauugaacuaccucgggagaaaaccgugaagacagcggccggugaagagaucaauauuaaggauauguuugucuauuacaaaacuauagacagcgcuaacgggggccuggagcucaucucccaugacaauucauucagccugaggggaguuggcucucgcacccuuaagagauuugaaaaauaucagguggauguguuggggaacauuuacaagguaaggggagagaaacgggucggucuggcauccagugcccacagcaagacgggcgaaaccauccgucccuuacaaucuacacgcgacuga

SEQ ID NO: 2734 - RNA, 3267 nt, Artificial Sequence
  Cas9 variant
augcccaaggaguucgacccucugaaaccagccaaguacagacucgcucuugauaucggcagcaaauccauuggguuugcaauaaucuuccugaaggaagacgugaacaaauuguuaaagccguaugccauugucaggucuggaguucggaucuuuggugauggccgcacccccgcggcuccugggcagcugggaucaagucuagccgcagagcgacgugugaagagaagcauuaggcggcaauacgcccgcaaaagaaagaggcuccagcggcugcuucgcaaucugaaagaauugggcuucuuuccagacgauuccaagcucugcaaaucuuucgaggaccugaaccccuaugaacugcgacacaagggucucacaaaggaguuaaaaccucaugaguuugggagacugcuuaugcacauggcuaagaauaggggauuccagucgaaccggaaaguagauuugcuggcagacaauaucgauucacaggccaaggcugaaacuagcgccaugaaaagugcgauagcaacgcuacaaucccgucucaacggcgaguuugaaacccugggcgccuaccuuuaugagcgcuucaagaaaggggagacaaucaagucuagcaagacucagaaaggacagaaggcugaauacgaguuuuccauuucaagaaggauggugaaacaggaguucgaccggcugugggccgcacaagagcaguuuaauccagaauuguucaacgagcaggcuaagaauacccucaaagauacaaucuucuuucagcgaaaccuguuaccccaaaaggucgguaaguguaccuuccugccugagcaugaacgcgccaguaaagcgcucccaagcucucaguauuuuagaauuaucuccgagcuuaauaagauaucauucacugacgccgaaggccugauuuugccgaucagccuagagcagaggaacaaacugcucaagagucugcggauuaaacaaaaacuuucuuuugaucgcaucagaacagaacugaauuuggacuccaccgugcucaucaaccuggagcacgcaagcaaggacucgauugagggggauaagacgggauacuuacugucuaagaaagaauacuucggccccgcuuggagggaccuaucccucgagacucaggaugccauaguuaccgcucugcuuacacaugaaaaugaggccgaauuggugcagaagcuggucgacgauuuuaacaucgcacacgacguggccaaagcucucgcgaacgcacgucuggagucacaguauaugcggcuuaguaaggaggccauugaacgacugaucccugaguuggaaaaggguguagauagccaagacggguacaaaguuccagugaaguaucacgaggcuacugaggccgcaggauucggccaucacuccgcccuccaggaaaauugggcugauuuucccacccuggacuuaaaacagcugcauucugaugacaacgacaaguacacagucgccgagcuaccucucccauauuacggcaaagugauaaccagacagguggcauucgggacgggagaugucaaugaccccguugaaaagagguuugguaaaauugcgaacccgacugugcacaucugccugaaucaaguacgcgugcuuuuggaugagaucauugcuaaguauggcuacccuuacgaagucaacaucgagcuggcccgggagcucaagcagaaucacgaacagagacagaggagcauuaaacaacaggcagccaacaagaaagagaaugaagagauacgccgagaaaucaagcaggcuuauaaaguggagaaggcccggauuaucacagacucagagaucagucgugcagauauugaaaaguggagacuguggaggcgcuccaaaagcaaguuauguguuuacucugggaaaaagauaugcgagaccaugauccugaacaaugaaguggaggucgaccauauucuuccccggucaagaacuggagauaacaguuaucagaauaaaguguugguacucaacaaggcuaauaggaucaagagcaaccgaacaccaugggaagccaaagagcuguucgaggcgcaaggcugguccuacgaagacauucuaaaccgcaugcgggcccuggauaagcaccagcucuuuagauucgcugaaaauucuauggacaucugggauaaaaacuauaggucguucgaagcacgugcccugaaugacacccgcuacauaagccggguugugaaggauuaucuuaaagucgugugucauaaggacagaaucgucguguccaacggugcucacacggccuugauuaggcgagaguuugggcugaaugacuuacucggcaagaaaggagagaagaaccgggaugaccaucgccaccacgcaaucgaugcgugcguuauuggcgcccuggacagaucaaugcuuaggaaacugcagaucgcuauggaaguggccgagaagcaaaauagugcacggaacuucguaggguugcaggaaccuugguuuaauuucucuacccagguccgaagaagcauaggacagauuuacgugucccauaaacccaaccacaauuacgagggugaaaucuuugaggcuucaauuuauggccuccgccugaucagcgauaagaggacagagaaauacguugggauaaagcguaacccagaaacuggaaagaccgacaaacccaagaaaucuguggucgugaucuccgauccuaagacacaaaaucgguauggccuaagacauaaauuccacagugagggucugccaaagaaguacuaugggcucucuagcuccucaguauuuugucuggaaauuuacagggacgagaaaggcaacuggcaggccuauacuaucccgcgcuacgaagcauaccgaauugugaagagacggggaguuaaugcccuuuaugauaacaaaaggaguaacuucgagggccgccccuuggucaugcgucugaugagagacgauugcaucgcuuuugagaagaauggggugaaagaaguguaccggauacagaagauuaacggauuaaagaaaaauaucacccucacaaggcacuucgacgcgaacgucgaugaccgcuaucgaagaaugcugaaggcccagaaagcagagaaggcuggugaagacuuugauagcgaggaccuuugugaugaccugguuuucucguccuuuggcgccucuagccuauacucaaauaaagcccggaaggugaccaucaguccuaugggggugcucagggauccaggauucaagggcuga

SEQ ID NO: 2735 - RNA, 3267 nt, Artificial Sequence
  Cas9 variant
augaagaaacuggugcucgggcuugacaucggggucgccagcguuggaugggguauuauagaugcugagaacggcgacgugcuggaugcagggguaagauuguucuccucuagggacgccucagaaaaugagagucggcgcaccagccgacgucaguccagaagguuaucucggcgcaagaaacacagaagggaacggaucaagcaacugcuacucgcgcaugauauggacgugugcgauauugucaacgagaaucccuaccagcugcgcgugaaaggacuuaacgaaaagcuggagaucucggagauuuauguugcuuugacacaccucgccaagcgaagaggcgugucauaccuggacgaugucguggaagaggguggggcaaucaaaagcgaacaucugaauaagaacauggaggagauaaaaaguggaaagaugccuugugaaauccagcucgagagguuugaaaaauauggccagguacggggcaugauugagaucaaucaagacacugaagaguccucuuucuuaguuaacauuuuucguacgagcgauuacaucaaggaggccaagaccauacuggcuacacagcagaaauuccacaagcagauuacuaaugaauuuaucgacgaguauauuaacaucauggcauccaaacgcgauuacuucaucgggccaggaaaugaaaagucaagaaccgacuaugguguguacaggacaaacggcgacaccugggauaaucuuuuugagauuuugauagggaaaugcagugucuucccggaagagacucgggccgcucgaagcucuuacguggcccaagaguuuaaccugcuaaaugaccucaacaaccugaagaucuccucacuugaaagcggaaaacugaguacaucucagaagcaugauauuguggagaaggucaaaaauuccaagaaauucggcaccaaggacuugcucaaauauaucgcgagcguuugugaaugcaagauagagaacauugaugguugucgcaaggacaaaaauagaaagcccaucaugcacacguuugaaaacuacaggaaagugcacaaugcacugaacgaggccgggguagauuuacggcugucggaggcugacuaugaugaacucaugaagaucaugacucuuaauucugagacccuggaaauuaaaaagcagugcaaggagaaauugccucaucuaacagaggacuaccugaacgugugucucguccugaauaagaaaggagccuucuccggcuggcacgcacuuucacugaaggcuaugaaauugaugaugccagaacucuauggcacuucuaagaaccagaugcaaaucauucauaccaugcagcuggggaaggccuacauaaaacccuuaaaucagcaaaaguaucugaacagcgaggcgauccuagaagagauuuacaauccuaucgccgcacgcuccaucagacagacaauuaaagugaccaacgcuauacucaagaaauacggaccacuggauucuguuaucauugaaaugcccagggacuaucagacgagcgaggacgagcguaagaugaucgagaaaaugcagaaggaaaaugaaaaggagaaaaaggccgcucuuaaacgggcccgagaagaguacccuuuuccagaugaggcauucagaaaccacaaggaauuggccacuaaacugaggcucugguaucaacaggaccaguucugcguguacucaggucgcaagauuagugucguggaucugguacggaacccgaaucaguuugagaucgaccacauaaucccccaauccguuagccuugaugacucucugaacaauaagguguuguguuucucagaagagaaccagaaaaagggccagcagacaccuuuuuauuaccauaaagggaagaguggaaauuggaccuaugaacaauacaaacucuucgucgagaagcuguuugauaagaaaaagauuagcaacaaaaagagagaguuacugcuauucgaagaggacaucaauaaaugggaugugaggcgcggcuuuauugcucgaaaccucgucgacacucgguacgcgucccgugugauccugaauaguuaucagcaguacuucgguaaccacgaaauggggacaaagguuaaggugguaagaggcaaauuuaccucgcagcuuaggaagaaauggaagauauucaaagaucgcaaugagagccauucccaccaugcaauugacgccuugaucgucgcugccacggcaaaccugcggcucuggaagaaaaauaagcugggaauuucagaugagggcaagguguaugacaaagaaaccggggagaucuuaccauuugaaaagcugacagccagugaguacaacgaaaugaugaauaaagagcccuaucuuaacuucaagacuaaauugcaaaacauagagaccaagguuaaguacucuuauaaagugagcaagaaagucaauagaaagaucuccaacgacacaauuuacucaacuagggaacgagauggaaucgacuacauuguggguaaaaucaagaauauauaugauguaaagaccuacaaagaccaguuucucaagcgcuauaaaaagaacaaagagcaguuccugauguaccaacacgauccucagacauucgcuauucuagaaagcaucauggccaccuauccagacgcagagaaucccuuucuggcguacaagaaggaacacggcgugauccggaaauaugcuaagaacaaagccggggcaccgguuacuucucucaaguucauugauggagcccugggccagaaaaucgacgucacguacaagaauaaggcugcccuuccuaaaaacaagaaagugguguugcaguccauuaagcccuacagagcagaugucuauuacgacgaggguaauaaaagguaucaucugauagggguuaaguacaguuuauuuagcuucucuaaacaaggcuaugugaucaacccaauugcuuaccagaagcuccuggagaaggaacagauccacuccgagaugaaauuuugcuucucacuuuaucgugaagauauuaucgagaguggagaagacccugauagccugacacgcuaccgguuuuggucgaagaaugaguccggcaaaaacaagauagaggugaaacccaucgaaaagccaaauuucgaggacagaaagguaauuaccaucacuaaaaagauuaaaaucuugaacaaguaccagaccgacguccucggcaauucuuuuaaagcccaagaagagaaggaucccaggagcauagaguga

SEQ ID NO: 2736 - RNA, 3267 nt, Artificial Sequence
  Cas9 variant
augaacuacaagaugggccuggacaucgggauugccagcgugggaugggcugucauaaaucucgaucuuaaaagaaucgaggaccuggguguuaggauuuucgauaaggcagaacacccccagaacggcgaguccuuggccuuaccucggcgcaucgcgcgaucugcucguagaaggcugcggcgcagaaaacauaggcuagaacggauucgccgacuccuggugucagagaauguacuuaccaaggaagagaugaaccuguuguuuaaacaaaagaagcagaucgacguguggcagcucagagucgaugcccuggagaggaaacugaauaacgacgaacucgcacggguguuacugcaccuugccaagcgucgcggguucaaaaguaauagaaagagcgagaggaacuccaaagaaucuucggaguuuuugaagaauauagaggaaaaccagucaauccuggcucaauaucggagcguuggagagaugauugugaaggauaguaaauucgcauaccauaagcgaaauaaacuagacuccuauucuaacaugaucgcccgcgaugaccucgaaagagagauuaagcugaucuuugaaaaacagagggaguucaauaacccagucugcacagagcggcuugaagagaaguaccugaauauauggagcucccagcgcccguuugcuucaaaagaagauauugagaagaaggugggcuucuguacuuuugaacccaaagagaagagagccccuaaagcgacguauaccuuccagaguuuuaucguaugggagcacauuaacaaguugaggcucguuagcccagacgaaacacgugcacugacugagaucgaacggaacuuacuguacaaacaagccuucucuaagaauaagaugaccuauuacgauauccgaaaacuccuuaaccuguccgacgacauucauuuuaaggguuugcuauacgaucccaaaucaagccugaagcagauagagaauaucagauuccucgaacuggacaguuaucacaaaauuaggaagugcaucgagaacguguacgggaaggauggaauacgcauguucaaugagacagacauugauaccuuuggcuaugcucuuacuaucuucaaagacgaugaagacaucgucgccuaccugcagaacgaguauauuacaaagaauggcaaacgggugucuaacuuggcaaauaagguguacgauaaaucccucaucgacgaacuguuaaaccugagcuuuucgaaguucgcucaccuaucuaugaaggccauuagaaauauacucccuuauauggagcagggggagaucuacuccaaagcgugugaacuggccggauacaacuuuaccgguccaaagaaaaaggagaaagcacuuuugcugcccgucauuccuaauaucgcuaacccaguugugaugagggcccucacgcaaucacgcaagguagugaaugcuaucauuaaaaaguauggcaguccggucagcauacauaucgaacuggcccgagaucuuucccacucuuucgacgagcggaagaaaauucagaaggaccagacugaaaaccguaaaaagaacgagaccgcaaucaaacaacugauugaguacgaauugacaaagaaucccacugggcucgauaucgugaaguuuaaacuguggagcgagcagcagggaagaugcauguauucauuaaagccuauagaacuggagaggcuacucgaaccaggcuacguugagguggaccauauccugcccuauagucgcucccuugaugacagcuacgccaacaaagucuuggugcugaccaaggagaaucgggaaaaagguaaccacacaccuguagaguaucucgggcugggaucugaaagauggaagaaguucgagaaauuuguuuuagcuaauaagcaguucagcaaaaagaaaaagcaaaaccugcuuagguugcgauacgaagagaccgaggaaaaggaguuuaaagaacgcaaucucaacgauacgcgguacauuaguaaguucuuugcgaauuucaucaaagagcaccugaaguucgcagacggcgauggcgggcagaaaguguauacuauuaacggaaagaucacagcccaucuaagaucaaggugggacuuuaauaaaaaccgugaggaauccgaucugcaccaugcugucgacgccgugauagucgcaugugccacccaggguaugauuaagaagaucacugaguucuacaaagcucgcgaacagaauaaggagucugccaaaaagaaagaaccaauuuuuccccaaccguggccucacuucgcagaugagcucaaggcgcggcugucgaaguuuccccaggagagcaucgaggcuuucgcccuuggcaacuaugacaggaaaaaguuggaaucccugagaccaguguuuguuucacgaaugccuaaacggagugugacaggggcagcccaucaggaaaccuuacgcagaugcguaggaauagaugagcagucuggcaagauccaaacggcugucaaaaccaagcucagcgacauuaagcuggacaaagauggucacuuccccauguaccagaaggaauccgacccaaggacauaugaggccauccggcagcgacuucuggagcacaauaacgaucccaaaaaggcauuucaggaaccuuuguacaaaccaaagaagaacggggagccgggccccgugauuagaacuguuaaaaucauagacaccaagaauaaagugguccaucucgauggaucaaagacaguggcuuauaacagcaauauuguacgcacugacguguucgaaaaagauggcaaguacuacuguguuccugucuauaccauggacaucaugaaggggacacugccaaacaaagccaucgaggcgaauaagcccuacucugaauggaaagagaugaccgaggaauauacuuuucaauucucccuauuuccuaacgaucuggugaggauugugcucccacgugagaagacgaucaaaacaaguaccaaugaagagauuauaaucaaggacauuuucgccuacuauaaaacuaucgauagcgcuaccggaggucuggagcuuauuucucacgaccggaacuucuccuugagaggcgucgggucaaagacacugaagagguuugaaaaauaccagguugauguguuaggaaauauccauaaggugaaaggcgagaagcgcguaggucucgcagcccccaccaaccagaaaaaggggaagacugucgacagucugcaaagcgugucggacuga

SEQ ID NO: 2737 - RNA, 3270 nt, Artificial Sequence
  Cas9 variant
augaccgccuucaagcccaacccucugaauuacauccucggccuugacauugggauagcuagcgugggaugggcaauggucgagaucgaugacaaagaaaacccaguuagacugauugauuugggugugaggguauuugagcgggccgaaaugccgaagacaggcgacuccuuagcggcugcccgccgacuggcacguucugugagaaggcuaacucggcgcagagcccacaggcuccugcgggcucgccgacuucugaaacaugagggggucuugaagcccgaagauuucgacgagaauggacucgugaaaccucugccauauauccccaagcagccuagaaacacgccauggcaacugagggcagccgcucucgaucggaaguuaacaccccuggagugggccgcgguucuuuugcaccuggugaaacaucguggcuaccuaucacagcgcaagaaugaaggugagaccgacgauaaagaacucggggcacugcuuaagggagucgccgacaacacucacgcucugcaggccggcaauuuuagaaccccugcagaguuggcucucaacaaauucgagaaggaaaguggccauauuaggaaucagcgaggggauuauagccacacauuuucccggaaggaccugcaagccgaguuagugcuccuguucgaaaaacagaaggaguuuggaaacccauacguaucugaugaccuuaaaaaugguaucgaaaaccuguugaugacccagcgcccggcgcuaucgggcgacgccauacagaagaugcuggggcacugcacuuucgagcccgcagagccuaaagcugccaagaauacauauaccgcugaaagauuuaucuggcucacgaaacugaacaaucuuaggauucugaaccaaggaaacgagcggccauugacugaugccgaacgcaccacacucauggacgagcccuacaagaagucaaaacugacuuaugcacaggccagaaaguuacuggaucuagacgauaccgcuuucuuuaaaggccucagguacgguaaggacaaugcggaaagcgcaacacugauggagaugaaagccuaccaugcuaucagucgugcccuugagaaggaaggguugaaggauaaaaaguccccucugucucucagcccagagcugcaggacgaaauuggaaccgcauucucccuuuuuaaaacggaugaggaaaucacuggccggcugaagggcuguuugcagcccgagauacucgacgcccuguuaaaacacauuucauucgauaaguucguucaaaucagucugaaggcucuacgaagaauugugccgcucauggagcaggggaaaagguaugacgaagccugcgcagagaucuacggagaccaucacggucgccggaacagcgaagagacacuguaucuuccucccaucccagcggaugagauuagaaauccugucguguugagggcucugucucaggcccgcaaggugauaaacggcgucgggcgacgguacggaucccccgcacguauccacauugaaaccgccagagagguuggcaaaucauuuaaggacaggaaagaaaucgagaagcgccaagaagagaaucggaaggauagagagaaagcugccgcagaguuccaggaauauuuuccaaacuucgugggugaacccaagagcaaagacauacucaagcugagguuauaccgacagcagaauuguaaaugccuguauagugggaaggagauuaaccuuggccgcuugaaugaaaaaggauacguagagaucgaucaugcucucccuuuuucucggacuugggacgauuccuucaacaauaaggugcugguccuaggcagcgagaaccaaaauaaggggaacagaacaccauacgaauaucugaauggaaaagacaacucgagggaguggcaggaauuuaaggcccguguggagaccucucgcuucccgcacuccaaaaagcagcggauccuccugcagaaauuugaugaagaggguuucaaggagagaaaccuuaaugacacgagguacguuaaccgauuuuuguguaaguucguggcggaucauaugcaacugaccggcaaagggaagcggcgcgucuuugccucaaauggacagauuacaaacuuacucagaggcuucuggggucugaggaaagugcgggcugaaaaugaccgacaccaugcacuugaugccguaguuguggcuugcaguacugucgccaugcagcagagaaucacccgcuucgugagguauaaggagaugaacgcauuugacgggaaaacagucgacaaggaaacuggcgaggugcugcaccaaaagacccacuucccccagccuugggaguuuuucgcgcaggaaguuaugauucguguguuuggaaaaccagauggcaagcccgaguuggaagaggccgacacaccugaaaaacuccgggcucugcuagccgagaagcugagcuccagaccagaggcaguacaugaauacgucgcuccccucuucgugucuagggccccgaaucgcaaaaugagcgggcagggacacauggagaccauaaagucaccuaagcgacuggaugaagguaucaguguugugagagucccacuuacucaauugaaacugaaggacuuagagaaaauggugaaccgggaaagggagcccaagcucuaugaggcacugaaagcccgccuugaagcucauaaggaugacccugcgaaagccuuugcagagcccuucuacaagcaggauaaggcuggcaaucguacgcagcaaguaaaagccgugagaauugaacagguucagaagacaggggucugggugcggaaccagaauggaaucgccgacaacgcuaccauggugagggucgauguuuuugagaaaggcgguaaguauuaccuggugccaaucuacuccuggcaaguggcaaaagggauucuaccugacaaggccauaaucgcguucaaggaugaagaggaguggcagcucauugacgauagcuuuaauuucaaauuuccccugcacccaaacgacuugguagaagucaucacuaagaaagcucgcauuuucggcuauuucgccucuugucaccgaggaaccggcaauaucaacauaagaauccaugaccuggauaacaagguggggaaaaauggaauuuuagagggcaucgguguuaagacagcacucucauuucagaaguaccagauugacgaacuggggaaagagauccggccgugcaggcuuaagaaacgcccucccgugagauga

SEQ ID NO: 2738 - RNA, 3270 nt, Artificial Sequence
  Cas9 variant
augaacgugagauacaagaucggccuggacauugggauaaccagcgucggaugggccguugugaaucucgauauccccaggauugaggaccuugguguacggaucuucgaucgcgcugaaaacccucagacaggcgagucccuggcauugccacgacguuuagccagaucugcgaggcggcgccugagaaggcggaaacaccgccuagaacgaauuagaaggcuccugauccgggaggggauacuuaugaaggaagaacuggacaaauuguuugaggaacgucaugagaucgauguguggcaacuccgcgucgaagcucuggacagaaagcucaauucagaugagcuggccaggguguuacugcaccuugcaaaacggcgaggauucaagaguaaccgcaagagcgagcauaauuccagagaaaacucuacuauguugaaacacauugaggaaaauagggccauccugucgucauaucggacgguugcugagaugauugugaaggacccgaaauuugcacuacauaagcgcaacaaaggcgaacacuacaccaauacaaucgccagagaugaccucgagagggagauacagcugauuuucacuaagcagcgugaauuugguaacaugaauugcaccaaggaguucgaaaacgaguauaucgcuauuugggccagccagcggcccuuugcgaguaaagaugacaucgaaaagaaagucggguucuguacauuugagccuaaggagaaacgagcaccaaaggccaccuacacuuuccaauccuuuaucgcuugggaacacauuaauaaacuuagacuggugucucccgccggaacaaggggcuugaccgaugaggaacgccggcuccuguaugagcaggcauuccagaagaacaagauaacguaccaugacaucagaacuuuacugaggcucccugacgauaccuauuuuaaaggcguaguuuacgaccgcaauaugccacuuaagcagaacgaaacaauucgauuccuggaguuggaugcuuaccaccaaauccggaaagugauagacaaggccuaugggaaaggaaagagcuccucauuccuacccauugauuuugacacuuucgguuacgcgcugacccucuuuaaggaugacgccgauguccguaguuaucugcagaacgaguacgaacagaauggcaaaccuaugccaaaccuugcaaauaagacauaugacaacgagcugaucgaagaguugcucaaucugagcuucaccaaauuugggcauuuaucucugaaggcucuacacaacauccucccguacauggagcagggagaaguguauuccucagccugcgagagagcuggcuacaaauucacgggucccaggaagaagcagaaaacuaugcugcuuccuaauauuccaagcaucgccaaccccguggucaugcgcgcauugacacaagcccggaagguugugaaugcuauuaucaaaaaguacgggaguccuguaucuauacacauugaacuggcgagagaucucucccagaccuuugacgagaggcgaaaaacuaagcgcgaacaagacgagaaccggaagaaaaaugagacagcaaucagacagcugauggaauauggacuuacccugaacccaacgggccaugauaucgugaaguucaaauuguggagcgagcagaaugggaggugugccuacucgcuccagcccauugaaauagagcgucuguuagaaccgggcuauaccgaggucgaccacgugaucccuuacucucgcucccuggaugacucauauacaaacaagguucuagugcucacuaaagagaaucgggaaaagggaaacagaacccccgcugaguaccugggugucggcacagaaagguggcaucaauuugagacuuucgugcuuaccaacaaacaguuuaguaagaagaaacgagaucgguugcugcgccuccacuaugacgaaaaugaggagacagaguucaagaacagaaaucugaacgauaccagguacauuagccgguuuuucgccaauuucauccgagagcauuuaaaauuugcagaauccgacgauaagcagaaaguauacacuguuaacgggagaauuacggcccaucugcgcucuaggugggaguucaauaagaaccgugaggaaagcgaccuucaccacgcuguggaugccgcaaucgucgcgugcacaaccccaucagacauagcuaagaucacugccuuuuaucagcggagagagcaaaauaaagaauuggcaaagaaaaccgagccucacuucccccagccauggccccauuuugccgaugaacucagggcucgccugaguaagcacccuaaagaguccauuaaggcccuaaaccugggaaauuacgacaacgagaagcucgaaagccugcacccaguguucgucucucgaaugccgaaaagaucagugacaggcgcagcucaucaggagacccuucggagguauguugguaucgacgaacgcagugggaagauucagacugugguaaaaacaaaguugagcgagaucaaacuggaugccuccggccacuuucccauguacggaaaggaaucugacccucguacguaugaggcgauaagacaacgguuacucgagcauaauaacgauccaaagaaagccuuccaggaaccccuguacaagccuaaaaagaauggcgagccagggcccauuaucaggaccgucaaaauuaucgacacuaagaaccaggugguuccgcuuaacgauggaaaaacaguggcuuauaauucgaacauaguccgcguggacguauuugaaaaggaugguaaguacuacugugugccuguuuauaccauggacaucaugaaaggcguccugccaaauaaggcaauugagcccaacaaaccuuacagcgaauggaaggagaugacagaggauuauacuuuccaguuuuccuuguaccccaaugaccucauccgaauugaacugccaagagagaaagccauccggaccucaacgggggaagagauaaagauuaaggauuucuuugcuuauuacaaaaccauccacaguggaacaggcgguauggagcuaaucucucaugacaggagcuucucccugucaggggugggcagccgcacucucaagagauucgaaaaauaucaaguggauguccugggaaacauuuacaagguuaggggcgagaaacggguggggcuugccucuuccgcacacaguaagaccggaaagacagugcguccuuugcagagcacucgcgacuga

SEQ ID NO: 2739 - RNA, 3273 nt, Artificial Sequence
  Cas9 variant
augagauggaggcugggccucgacaugggggccggaagccuugguuggugcgcugugggccuggaugaccagggguaccccgauuccaucuuggcagccggaucucacauuuucggcgacggucgggcgccuucacgcggggaucaacagggaaccccauuaggcgucgagcgacgugcugccaaggcaaugagaaggcggcgcgacagauuucugggcaggcaggccaagcuacucgcucggcugacacuugcagggcuguucccggccgaucccguucgcgcuaaggccuuggaacuccuggacccuuaugugcugcgagcgagagcacucgaugaggccuuaccaccccaucagcugggaagggcuuucuuccaccuuaaccaacggcgugguuuuaaaaguaaucgcaagacugacagaggcguagaugacgaagccgggaaaauagcaaucggaauugauagguugcgggcugccaucgcggccgcagaggcucgaacgaugggcgaguuccugcauaagcgcagacagagcgccccugacgugaaccagauuccauccgucaggacccggcuacgccccgagacaggugaggaagcuaagggggacggauacgauuuuuauccuggcagagagcucguggaagaggaguucgacgccaucugggaugcacaggccccacaccauccgucucugcuuacucccgacaauagggcucuguugcacgaagcgauauuuuaccaacguccucucaaagcaccaaagaucggcaaauguacccuguuaaacaaugagccccggcugccuaaggcccacccacucuuccagcgaagaaggcuucuggaagagguuaacgcuuugcgcauugugcggcccggggaagucgccacaaaacuaaccugcgagcagagagaucugcucaugcugaagcugaaggacaaagcaaaggugucguuugagacucugaggucaaaaguauugaagcucgaaccggaggcccgcuucaauaaagaaggagagaaccgaacagaacugguuggugaugaggugugugcucagaugagcgccaagacccgguuuggcaaagcaugggcgcauuucacggacgagaagcguugggcuaucuuaaguagacugauugaagaggaagaugaggaaaggcuagacacuuggcuccgcaccgagcacgggcuggaugccgagcaagcacgggccgucgcuggagccagacuuccugcaggcuucgguagguuuggggaaacagcuacucgacgcuugaucgccgcgcugcaggccgaggugauaguguauuccgaagcugucguugcagccggccucggacaucacucugacaugcggaccggcgaggugcuggcugagcuucccuacuaugggaugacacuggaaagacacuugcucccaggaaccggugacaaggccgauccugaggaacugaggauuggccguuuaacgaaucccacuguacauaucgcacugaaccgccuacggagaauugugaauaggcucaucaaaacauacgggcgaccagagcagaucgcgauugaacugggacgggagcuuaaguugaccgacgaggauaaacaacgccugagcagacagaacaauaggaaccgggccgacgcugaagcccgauccaagaaacucgcagagcugggccaggcugauaauggugccaacagagcacgcuuaaagcugugggaagaacuuaacagggaaaaugccuuggaccgucggugcauauacucagggcagcaaaucaguauugcuaugcucuuuagcgaugcggucgagguggaccacauccugcccuuugaugccacucuagacgauucuaacaauaacagaauacugugucucagggaguggaaucgccgaaagagaaaacaguccccuuaugaagcauggggccauacagacuacuggccagauauugcugcccgggccgcuaggcugccgaaggagaaacgcuggcguuucgaacccgacgcaaugcagagauuuucagccgaggaccgguucaucgcgaggcaccuuguugauacccaguauaugagccgcuuggcucgagaauaccuggaggccuuauauccugagaagggagaaggcagugggcaugugugggucucuccaggaagacucacggagcugauccggaggaaacuuggucugaacgaauugcuccccgaccacaauuuugcaggcgugaagaaccgccuggaucacagacaucacaccauugacgccuucguaguugcugugacagauaggucccuacugcaagggaucagccgggcaucggcccucgagggagaggaaggccgugagcgcgucauugugccugaaccaugggacgguuuucgagaggcgcugagaacuacccuuaauacaauaacugucuggcauaggcaggaucacgggaccgcuucuaaggccggcuuggcacagggacgggaccagacagccggcaaacugcacaacgauaccgcuuacggguuaacuggacgccaagacacgaagggcaaugaucucgugguuuccagaaaaccccugaugucacuuaagccggccgacaucgaaccugugccagauguagcacccauuacaaaaggugucagggaccgggaccugcgaaaggcucuagcccauuucacccaggcgacugaggggaagggauuucuccaggcccuggagagauucacccgcuugggcccucugcacuuuagggguauccggcgugugagauuaauccagccccucgcaguuauuccaauaaaaggcccugggggagugcccuauaagggcuaccuugggggagaaaacuucaggugcgaugucugggagaugccagacggcgcuuggaaaccggaagugacaaguauguuccaagcccaucagccugguuggaccagcgcuauccgcgcagccugucccacugcccggaagguacuuucccugcacaaacgagauaugauugcuaucgagagagaagagggggugaggacauugaugguugucgcgcagauuuggucuaauggacaagugacgcucguggagccacaugaagcaggcgaccugaacaagcgcaauaaaagcgaggaugaccccuuugguuacuucaugccuaccgccggcgggcuaaagcggcugaaggcuagacagguccguguugaugaacuuggaagggugcaggacccaggcuuucccgcccggaaagcacgccgaagaacuaggccuaaacagguggauuga

SEQ ID NO: 2740 - RNA, 3273 nt, Artificial Sequence
  Cas9 variant
auggacuggagacugggccucgaucuuggggccaacagccugggaugggcugcauugagguuagaccgggccggugaucccaucggcauucuggcgauggggucccgcauauucucugacggacgagauccuaagucaggcgcuagucuagccguggaccguagagcagccagggcuaugcggcgcagaagggaucgguuuaaacagcgccaagcagcccuccugaaguaccuuauccgagacggucuguucccagcugaucaggccgacagacagagguuggcggaugaggacccguaugcacuccgggcccgugcucuggaugaagaacugagccucuuugaaauugggcgcgccuuauuccaccugaaucagagaaggggauuucaauccaaccggaaagcagaccgaggccaggacgaugaggcuggcaagaucgccgucgggguugaccgccuuaaucagcagauggaggagcaaggagcgagaaccuugggugaguuccugcaucagaggcggcgcgccgcaacagaugcuaaccacauucccucugugagaacuaggcuacguccugaaacgggcgagggggccaaaggagacggcuacgauuuuuauccaucgcgggcucucaucgccgaagaguucgaggaaauaugggcagcccaggcuccccauuacccugacacccugacacagcaaguacacgaucgacuuuaugagaucauuuuucaucagagaccacugagggcgccccaggugggucaaugcacuuuggucgcaggggaaacccgccucccuaaggcccacccacuguuccagaagcggagauuacuggaggaaaucaaugcucucaugauugugaggccgggagagaucgcccagcgccuuacacccgaggaacgagacacccuguacuugaaacuaaaggauaaacggacuguuucauuugcaacacugcguaagacccucaaacuggacagcgccgcuagauucaacaaggagagugaaaauaggacggagcuuaagggcgaugaaguggccgcagagcugggcgcgaaaacucgcuuggggacccgguggcagcaccucuccggagaccaacagugggaggucgugcauagacugauggcuuuagaaucucaggccgacgaggcagccuuuagggauuggauaagccagacauaugaccugcuaccugaacaagcugccgcaguacucggugcucgacugccacagggccacgggcgcuucggacccacugccaccacaacccuuauugauuccuugcugcaugaccggacggaggauggcagaguuguggucuacucagaagcggugcagaggaguggucucgggcaccacagcgaccugcgucaugaucgcgacgaugaggacgugacugagcuuccuuacuauggcgucgcccuggaacggcacaucaugccaggaacagcugagcccaccgauccggaagagaugagaauuggcagguugacuaacccuacaguucauaucgggcucaaucagcugcgacacgugguaaaccgguuaauccgcgcauacggacccccaaaggagauugccauagaacuggcuagagagcuaaaacucucugaagacgagaagaaaaagaggaacuccgaaaaucgggauaaucgacuggccgcagaggguagaucaaagaaacuugaggaaauccgccaaagggacaccggcgcgaaccgugccuugcugaagcucugggaggaacugaauccugggaacguguuagaccggagauguauuuauacgggagagcagaucagcauagauaugcuguucagugacagggucgaaguggaucauauucuucccuuugcucagaccuuggacgauucuaacggcaauaaacuccugugccuacgcgaggccaaccgagagaagagacggagguccccauacgaagcauggggucacacagaccgcuggcccgauaucgcugagcgugccagcagacugccuaaaccaaagcgguggagguucgaaccggacgcaaugcagcgcuuugccacugaggauggguuccucgcucgacaccugguugacacccaauaucuuggcagauuggcgcgggaauaccugucgugguuauaucccggaaggggcgaggggucuggacaugugugggucuccccuggucgccucacagagauggugagaaggaaacugggccuuaaugaucuguugccagaccacaacuuugggggaggcgccgaucagcccaagaaucggcucgaccaucgucaccacgcaaucgacgcucugguaguugccauuguggaucgcgguaugcuacaggccaucgcucgagcaucagggcaagacggcagugaaggaagagagaggauucauauaccugccccaugggauggcuuccgggacgaucugcgcgucgcggugaacgggaucauugucagccacagacccgaccauggaacuguggcuaaggccggccucgcaaggggucgggaucagaccgccgggcgacugcacaaugacacagcuuacggacuuaccggcgaaacugaugcaaaagguaacuccaucguugugagacgcaucccguugucugccauuaagaaaccugcggacauagcuaggguacgggauccacuguuacguaaugcccucgcagaguuuacgaagggccuggacgggaaagccuucgaggcuagaaucggaagguuucaugaacuuggcccccugcuauaccgcgggauucggcgagucagagugguugagacacucaccgugaucccuauuagggacgccgaaggacgcgcauauaagggcuacaagggugauagcaacuaucgguacgacgucugggagaugcccgaugggaaauggagaugucaggugguaucaauguucgacgcucaccagaguacugaacaagcccguccacacccugcggccaggaagauccuguccuugcagcggaaugauauacuggcaaucgagcgcaccgagggagaccgagaauuagugagaguugucaaauuuagcgagaagcaguucgcuguggcucccccacaugaaggcgguucucucaaaacaagggauggcaacgccgacgauccguuucgguaucuguacccuucacccaauacccuuaagggguggcgcgcaagacaggugaggauugacgagcugggacgagucuuggauccaggcuuccccgcccggaagaguguucguagaacucgcccuagggccgcuccaguggacuga

SEQ ID NO: 2741 - RNA, 3276 nt, Artificial Sequence
  Cas9 variant
auguacagcaaccuccuguucuccuuugacaucggcaccaauucuauuggguggugcguguucgcccuugaugaggcuggagaacccuauagaauagucgaccugggugcaaggaucuacgccgauggccgggacccucagucaaagacaaguuuggcgguugcucgccgagaggcccgugcaaugagcagaaggcgggaucgcuauuuaagaaggcggaaagccacucugcgcacgaugauugaauacgggcuaaugccaggagacaaggcuggccaagaggcagugcuccgagaaaccggugauagagaagggggagacgaguccuuuaacccguaugcccugagggcucgggcccuuucugaaaaacugcccccugcguacaucggccguguauuguuccaccucggccagcgcagaggguuuaagucgaauaggaaaacagaucggaaggacaacgauaagggaaaaauugcacuggguaucgacgagcugacugccgcuaugcaucgaucaggcagcccaacccucggggccugguuagcaaugcgcagagcugaaggacacagugugaggcugcgggccggcuccgaggucuucgaugcggaggguuaugccuuuuaccccgaacgcucucuuuuggaggacgaauuuagacagauaugggacgcacaggcugugcaucacccugauauccugacaccagagaggcgugcccaucuauuccggguuauguucuaccaacgaccccucaagaaaccucugguggggagauguagcuuuaauccagcugaguucaggcuuucccgcgcccacccgcuguuucaggaguuccgguuguauaaggagauuaacgaccucgaagucgugcugcccgaucagucacacagaaaauuaacccuggacgagaggaaugcacucguagccaaacuuaagacuucccgcaaagcuagcuucucugcgcugcgaaagacauugaaacuaaccccugaucugguuuuuaacaaggaauccgaggcacggaaagaacuccugggagacgagaucuacucagugcuugccgaugcuaagauguucggcgcccguuggggcggguuuagcagagcaaggcagugggagauuaucacgcgccugaaagaagaggaagacccagccaguuugucuuccuggcucaagagcgaguucggacuggaugacgaacgggucacugcuauagccaaugcaucguuacccgaugguuauggcagacugggggagaccgcgcuagcuucuaugcucgaggaacugaagacagccgugauuccugaguccgaagcagccaggcuuugcggauacgaccauucaaacuuggcuaaagagcaagacgagggccuggauacucucccagaauaucaggagauccuggaacgacacauucccccggguaccggggacccugaugacaucuacgaucuucgcaagggccggaucacaaaucccaccgugcauauuggacugaaccaguugagaagggucguuaaugcccucauacaccguuuuggccgcccacagcggaucgugguagagcuggcaagagacuuacaacugagugaaaaacagaaggaugacgugaacaggcgaauugcuaaaaauacgcgggaggccgaggggcgcagccagaagcuaaucgaaaugggacaacucgauacugguuauaacagacugcuuuugaagcugugggaggaacucaaccuggacaaaccugaggauagggucuguauauacuccggcaagcccauugggaucgcgauguuauucucuggagaaguggacguugaucacauccugccauggagcaaaacacuugacgacucacaggccaauaaguugcucugccugaaaagugcuaaccggcagaagcgaaauagaacccccuccgaugugccugaguggcgcgacagguacgaugagguccuagcacgugccgcucggcugccaagaaacaagagguggcgcuuugccgcagacgcgaugcagcaauucgaagccgagggcgguuuucucgcucgacagcugacugauacacaguaucuuagcagaauggccuuggaauaccugucugcauuauauccgucagaggaagcugacaaaaguggggagcuccggcagaggaagcgcgugcauguaguucccggccgucugaccgagcuucugagacggaauuggggauugaacacgcuccugccugaucacaaucuaggcgaaauggcccaagagaaaaacaggcgcgaccaucgacaccaugcaauugaugccgcugugaucgggaccacaagcagaucccugcuccagcggaugucuggagcggccgcaaggcuggacgaugucgcuuucgacgaucuugugcgcacugucgugaaggacaauccacccuggccugguuuuagagaagaguugcuggccgccauuggcaggguuaccgugucgcacaaaccagaccacgggacaguaagccgggcugcauacgcccagggaaagggccagacugcggguaaguuacauaacgauaccgcuuaugggcucacaggccuggucgacgccaaaggaaguccccuugugguucgucgcaagccguucauggcacuggaggugaaagauauagccucaauccgagacaccgaacuacaaagugcucucuacggcgcaauugggucucugacugagaagaaagccuugcaggaagcgcugaucagauuuagggauacgcacccucaguucaagggaauccggcgcgucagaguguuagagacacucagcguaauuccaauaguggacagggauggcaaggcuuauaaggguuacaagggggacgccaauuaccgguaugaaguuugggagacccuggauggaaaauggcauacugaggucguguccauguucgacgcacaccagcccggcuggcaaucaccuuuucacaagcagaaccccgccgcucgaagagugcuuaaacugcagcaaaaugauauggucgccuacgaacauccagcagacgguuauaccaucgcucgcguugugaaguucagcaacgacaaaaggauuuacuuugccucucaccgggaguccggcaguuugaaggcgcgugaugccgacaagggggauccuuucagcuauuuugcaaaagcuaauaacggacucagagacaucaagugucgccaggugaggauugaugccgcuggccggaucuucgaccccgggccacaggaucgagaaacaagacaggcaaacaaaggaguauga

SEQ ID NO: 2742 - RNA, 3279 nt, Artificial Sequence
  Cas9 variant
auggccuacaccaugggcaucgacguggggauugcuagcugcggaugggcaauagucgaucuggagagacagaggaucauugacaucgguguucggacauucgaaaaggccgagaaccccaaaaauggcgaagcgcucgcugugccucgccgagaggcccguuccucuagaaggcggcuucgcagaaagaaacacaggauugaacggcugaaguauauguuuguacgcaacggguuggcaguggauauccaacauuuagagcagacucugcgaucacagaaugagauagacgucuggcagcuaagaguggauggacucgacaggaugcugacgcaaaaagaauggcuucggguucugauccacuuggcccagcgucgcggcuuccagaguaacagaaagaccgaugguagcuccgaggacggacaggugcucgucaaugugacagaaaacgauaggcugauggaggagaaggacuaccggacuguagcugaaaugaugguuaaagaugagaaguuuucugaccauaaacgaaauaagaacgggaauuaucacggcguggucucgcgcgcaucacugcucguggaaauucauaccuuauucgagagccaaagacagcaccacaacuuucuggccaguaaagauuucgaacuugaguacaucaauauuugguccucucagaggccaguggcuacaaaggaccagaucgagaagaugauaggcaccuguacauuuuugccgaaagaaaagcgggcccccaaagcgagcuggcauuuccaauauuuuaugcugcuacagacuauuaaccacauccgcauuaccaaugcacaggggacgagaccucucaacaaggaggaaaucgagcaagucguuaauauggcccugacuaaauccaaggugucauaccaugacaucaggaaaguacuugaucugagugaagaguaucaguucgugggauuggacuacgguaaggaggaugaaaagaaaaaggucgagagcaaagaaaccauuauaaagcucgacgauuaccacaaacugaacaagaucuuuaacgagguggaauuagcuaagggcgagacaugggaggccguugacuaugauacuguggcauacgcucugaccuucuuuaaagacgaugaagacauucgugauuaucuccagaauaaguacaaagacucuaagaaccggcuugucaaaaauguggccaacaaggaguauacaaaugaacugaucgagaagguauccaccuugucauuccgaaaaguugggcaccuaagccugaaggcgcucagaaaaauaauuccauuccuggagcagggaaugacguacgacaaggccugccaagcagcuggcuuuaacuuccaggguaucaguaaaaagaagaggucugugguccuucccgugaucgaucagauuuccaauccugucgugaaccgcgcccugacucagacacggaaaguuaucaaugcuuugauuaagaaauaugggagcccagaaaccauacauaucgagacugccagagaacucucgaagagguuugacgagcgcaaaaacauuacaaaggauuacaaagaaaaucgagacaagaacgagcgggcaaagaaacaccugucugaguuaggaaucaucaaucccaccggccuggauauugugaaguacaaacuauggugugaacaacagggccguugcauguauuccaaccagccuauaucauucgagagacucagggaaaguggguacacggagguagaccauaucauuccauauagccgcuccaugaaugauucuuacaacaaccggguccuggugaugaccagagaaaauagggagaaaagcaaccagacaccguaugaguacaugggaaaugacacucaacgaugggaugaauuugagcagcgcguuaccacaaacccccagaucaaaaaggaaaagcggcagaaucuuuugcugaaagguuucacuaacagaagggagcucgaaaugcuggagcguaaucuuaacgacacccgccacauuacaaaguaucugucacauuuuaucaguaccaauuuggaguucuccccuagcgauaaaaagaaaaagguggucaacacuucuggccggauaacgucacaccucagaaguaggugggggcuggaaaagaaucgagagcaaaacgacuuacaccaugccauggaugcugugguaaucgcggugacaagcgacuccuuuauucagcagguuaccaauuacuacaaacggaaggaacgcagagagcugaacggagacgauaaauucccacuacccuggaaguuuuucagggaggaagucaucgcacggcucucuccuaauccaaaagagcaaauugaagcccugcccaaccacuuuuauucggaggacgaacuugcugauuugcagccgaucuucgugagccgaaugccuaagagauccauaacuggcgaggcccaucaggcacaguuccgcaggguggucgguaagaccaaagaggggaagaacauuacagccaaaaagaccgcucugguugacaucucauacgauaaaaauggcgacuuuaacauguauggacgugaaacugaucccgccacauacgaggcaauuaaggaacgguaucucgaguucggcgggaaugcgaaaaaggcuuuuaguacggaccugcacaagccuaaaaaggauggaaccaaagguccauuaaucaagucugugagaauaauggaaaacaaaacucuggugcaccccguaaauaagggcaagggggucguguacaacagcuccaucguuaggacagacguguuccaacgcaaagagaaguauuaccuuuugccagucuacgugaccgauguuacaaaaggaaagcuccccaauaaagugauugccgcaaagaagggcuaugacgauuggaucgagguagacgacucauuuacuuuccuguacagccuauauccuaacgaucugauuuuuauccgacagaauccaaagaagaaaauaucucucaagaaaagaauugaaucccauaguaucagcgacucuaaggagguccaggaaauccugaccuacuauaaggguguggauuccucaacggccgcuauugaguucaucacccacgacgggaguuacuaugccaaaggcgugggaguccagaaccuugauuguuuugaaaaguaccaaguugacauuuugggcaauuacagcaaagugaagggggagaaacggcuggaguuagaaacaucggauaacaaucauaagggaaaggacguaaacuccauaaaaucuacuagcagguga

SEQ ID NO: 2743 - RNA, 3279 nt, Artificial Sequence
  Cas9 variant
augaaguacagcaucggccuggacauugggauagccuccgugggauggucugucaucaacaaagauaaggagagaauugaagacauggguguuaggaucuuccagaaagcugagaaucccaaggauggcucaagucucgcaagcucccggcgcgaaaaacgagggucucguagaaggaaccggcgcaagaagcacagacuugacaggauuaaaaauauccugugcgagucgggauuggugaagaaaaacgaaauagagaagaucuauaaaaaugccuacuuaaagucaccuugggagcugcgggcuaagagccuagaagcgaaaauuaguaacaaggagaucgcccaaauucuccugcauaucgcaaaacgccgaggcuuuaaguccuucagaaaaaccgauaggaaugccgacgauacagguaaguugcugucugggauacaggaaaacaaaaagauuauggaggagaagggauauuugacuaucggcgacaugguagcuaaagauccaaaguuuaauacgcacgugcggaacaaagcaggcagcuaccucuucuccuuuucacguaagcugcuggaagacgagguccgcaaaauucaggccaagcagaaggaacucgggaauacccauuucacagaugacguguuagagaaauauaucgaaguuuuuaacagucaaagaaauuucgaugagggaccgagcaagcccucuccuuacuauuccgagaucggucagauugcuaaaaugauaggcaacuguacuuuugaaucaagcgagaagaggaccgccaaaaauacauggaguggggaacgguucguguuucugcagaaacuuaacaacuuccgaaucgucggauugucuggcaagcgcccacugaccgaggaagagagagacauuguggagaaggaaguauaccuaaagaaagagguuagguacgaaaagcuccggaaaauccuguaucuuaaggaggaagagagguuuggugaccugaauuacuccaaggaugagaaacaggacaagaaaacugaaaagacaaaauucauaagccuuauugggaacuauaccaucaagaaacucaaucugucggagaaguuaaagucugaaaucgaggaggauaaauccaagcuggacaaaauuaucgaaauucucacguucaacaagucagauaaaacuauagagaguaaucuuaagaagcuggaauugagcagagaggacaucgaaauucuacuguccgaggaguuuucuggaacccucaaccugagccuuaaagcgaucaagaaaauccugcccuacuuggaaaagggccucucauauaaugaggcaugcgaaaaagccgauuacgacuauaagaacaauggcauuaaguucaaacgcggggagcuguuaccuguggucgauaaggaccugauagcuaacccaguggugcuacgugccaucagucaaacacggaaagucguuaaugcaauuauccgaaaguacggaacuccccacaccauucauguggaaguagcuagagaucucgccaaauccuacgacgacaggcagacaaucauaaaggagaacaagaaacgcgagcuggaaaaugagaagaccaaaaaguuuaucagcgaagaguucgguauuaaaaacgugaagggcaaacuuuugcugaaguaucggcucuaccaggaacaggaggggagaugugcguauucuaggaaggagcugucacuuagugaagucauccuggaugagagcaugacggacauugaucacaucauaccuuacucccgcucuauggacgauucguauagcaauaaaguguugguucucuccggagaaaaccgaaagaaaucaaaccuguuaccaaaggaguacuuugaccggcaaggccgugauugggacacuuucgugcugaaugucaaagccaugaagauucacccgagaaagaaaaguaaccuacucaaggagaaauuuacaagggaagauaauaaggacuggaaaucucgcgcacugaacgauacccgguauaucagcagauucguggcuaauuaccuugagaacgccuuggaauacagggacgauucccccaagaagcgaguauuuaugauuccuggucagcugacugcucagcuccgcgcccgguggagacugaauaaaguuagggagaacggggacuuacaucacgcacuggacgccgcuguggucgcggugacagaucaaaaggcaaucaauaacauaucaaauaucagccguuauaaagaacuuaagaacugcaaagacgucauuccaucuaucgaguaccaugccgaugaggaaaccggcgagguguauuucgaagagguuaaggacacgcgcuuucccaugccuugguccggauucgauuuggaacuccagaagcggcuggagagugagaauccaagagaagaguuuuacaaccuacugagcgacaaaagguaucucggcugguucaauuacgaagagggguucauugaaaagcugcgacccguguuuguaucucggaugccgaaccgcggagucaaaggucaggcucaccaggagaccaucagauccucaaagaaaauaaguaaccaaauugccgugagcaagaagccucuuaauucgaucaaauugaaggaucuggagaaaaugcagggcagggacacagaucggaaguuauaugaagcacucaaaaaccgacuggaggaauacgacgauaagcccgagaaagccuucgcugagccauuuuacaagccuacuaauuccgggaagagaggaccccuuguucgcggcaucaaaguggaagagaagcagaacgucgguguguauguaaaugggggccaggccucuaacggaagcauggugaggauugacguuuuccguaaaaauggcaaguuuuacaccgucccaaucuaugugcaccaaacacuguugaaagaacuccccaaccgggcaauuaaugggaagccuuacaaggauugggaccugauagacggaucauucgaguuucuauauaguuucuacccaaacgaucugaucgaaauugaguuugguaaauccaagucuaucaaaaaugacaacaagcucacuaaaaccgagauuccggaagugaaucugagcgagguccuuggcuauuacagagggauggauacauccaccggagcggcuacuaucgacacgcaggauggcaagauacagaugaggaucgguauuaagacaguuaaaaacaucaagaaauaccagguggacguguuggggaauguauauaaggucaaacgcgaaaagcgacaaaccuucuga

SEQ ID NO: 2744 - RNA, 3285 nt, Artificial Sequence
  Cas9 variant
augaaaagcacccuggccaucgcuuccauuucuucacucggcugggugauagagcuuggggaaaacagaaucaugaggcugggauuggacauugguaguacaagcaucggcugguggauuuacgagacuacggaugggcagaucaccuccgucauagacggaggcguucggaucuucucugauggucgcgaccccaagucgaaggggucauuagcaguggaucgacguguagccagagcgcaaaggcggcgcagagacagguaucugcggcgcaaagcugcccuaaugaagcgaauggcagaagugggacucaugccuagcgauccaaaacaggccaagcagcuggaggcucuugacccguacgaacugagagcaaggggcuuggaugagacacucgagcugacugaacugggccgggcccucuuucacuuaaaucagcgucgcggguucaagaguaacagaaaaaccgacgcuggagauaaugaguccgguaagauuaucgacgccacagcgaggcuggauugggcaaugcgggaccaucgagcccgcaccuauggcgaauuucuucacaugagaaggcaaaaagcugacacuccccggacaaccccugccguccgcacgagauugacuauugcagcuagggauggggccgagaaggaggaaucuggauacgacuucuauccagaucgucagcaucugcgggacgaguuugaugcgcuaugggaagcccaggcagaguaccacggcgugcucaccgaagaccugcgagaugagaucgguacaauaauuuuccaucagagaccccuuaaaacuccuaagguugggaagugccuguuuaccaacgaggaaaggguggcuagcgcccacccauugaaucaacgccggauccucgucgagacagugaacgcucugagaguagcccaguuaggagaaguugcaagggcccugacccucgaggaacgcgacacgauucuucacgcucuggauaauaaagcgcauacuaaguccuugucaggcaugaguaucaaacuaaaggcacugggcaaagugaucaagcuccgaagcgggcaguauuucacacuggagaccgccaaccgggacgcuauugccugugaucccguccgugcaucucuuuccaaaccugacagaauaggaucauacuggagcacucuggaccacaaugcccagugggagguggugaacaggauccgcgcuguccaaagugaugccgaccaucgggaauugguugcauggcucgugucucagcacagacuggcggcugagcacgccgaaggugcagccuacgcuccauuaccggauggcuauuccaggcuggggauuacagccaccaagcgaauccuagcagcucucgaggccaauguaauacccuacagcaaggcgguggaaucgugcggauggcaucacucugacgagcgcacgggcgagguccuggaucggcuuccuuauuacggugaaauuuuggacagacaugugaucccagggaccuaugaugacuccgaugacgauaucacaagguuuggccguauuacuaaccccaccguucacaucggacugaaucagcuccgccggcuggugaacagaauuauagagguccauggcaaaccugacgaaaucgugguagagcuugccagggaucugaaguugucacaagaccagaaagcugacguugagcgaacaauuaagaaaaauacucaggcagccauccggcgcggggaaaagcucgaggaaaugggagugccaaacaccgguggcaacagaaugguccugagguuaugggaggaucugaaugacgaugacgugaugaagcgguucugucccuacacagggcagcgaaucagugcuggaaugcuauuugauggcagcugcgacgucgaucacauucucccguucuccagaacccuggacgaugguuuuacuaacaaaacgcuuuguuugaaggaagccaaucgcaaaaagaggaacuaugcaccucacgaggcggccgagaaagggcugcucgaccgugaugcuauggacucuguggccaaguaccugcccgauaauaaggcauggcgguucgcuccagacgccauagaaagauucgagggcgaaagggacuuuacagcacgcgccuuaaaagauacccaauaccugagccgacuugcuagaacuuauuuggacgcgcucuacgauggaggcgacgauaagucacauguuugggugguaccugggcggcugaccgagaugcuaaggcgccacuggggacugaacggucucgaagcccuggcagacagugaugagaaaacagucaagcguaaaaauagaaccgaccaucggcaccacgcuaucgaugccgccgugguugcugcaacugacaggucccuuauucagaagaucagcaagauugccgcgucugaugagcaggcuggcgccgaagacacauugaaaucaacgcccccacccugggacaguuuccgcgaugacaucgcagcccagcugcaaaacauaaccgugagccaucgagcugaucacgggagaacugacuccuuagcaaagggacggggcgaggauacaaccucuggugcccuccaugaagcgacagcucuggggaucauugacgagacucacgucaccgugaggaucccuauugaaucgcuuaaaagcggccaucugaucgagggaucccgcaauggcuauauaagagauccauacuugagggaccagcucacgcuggccaccaagaacgggucagauaaagacuuuacaacuguacuacagaaguucuuugaucggaguaaacguuauggaggcacccgccgagugagaauuaucaagacacugcaggacacugcaaggauuucuguuccgcacaaugcccccaucaaggcuuacaaaggugggagcaaccacgccuucgagauauggcggcucccuaauggaaagaucgaaucccaagucauuaccacgugggagcaucacaaccugacagaaccaaaacgcccccauccugcagcuaagagaaucauuaggcuucacaaaaccgauaugguggccaucgagcgggacggcaagacugugauaugcuuuguccagaagacagacccaucaaauggugcguucuugguuccccauuuugaggccaacgcagauggccgaaaaagaaagaacgaaccgguggagugguaucagaugagcgcuaauucucugauuaaagccgacuuacgcaggguggggguagaugaaaugggacggguccgugacccuggcccacccccuaucagauga

SEQ ID NO: 2745 - RNA, 3285 nt, Artificial Sequence
  Cas9 variant
augaaguacagagugggcuucgaccuggggaccaacagccucggaugggccgucguuaggcuuaaugcuuccggugagcccgaucggaucgaaguggcaggcucucgcauauuuucagacgggcgagagccuaaaaguggagccagccuggcgggcgcucguagagaugccagggcaaugcggcgcagaagggaccgguucaagcagcgccaagccgcuuugauuaaauauuuaacacaggcaggauuuuucccagccgaugaauccgagcgaaaggcucugucugcccuagacccguacgaacucagagcgagggcacuggaugaggcccuuccccuggcucacuuggggcgggcccucuuucaucugaaccagcgucgcggauucaaaucgaauagaaagacugacaggggcaagaacgaugacacgggcaaaauccggauugggguagcacgacuguaugagcagaugcgcgaugcugacgccagaacccucggagaauuuuuacacaagaggcgggcggccgcaucagauccuaaugcuaucccacaugugcgcacaagaauugucacucuggccgcugaggacgguaaagccagcgacguguacgauuucuaucccgacaggcaaacccuugaagaggaguuugaagcaaucugggaggcccagacaagucaccauccugaggcuuugaccgaggaacgucgggcgcaguucuacgagauaaucuuucaccagcgaccacugaagcaacccaaaauuggcuucugcacucuacucccuccagagaagagacugccgaaggcacacccccuuuuucagaggcgccggcuguuggaagagguuaacgcccucagaaucgugcugccugggaaagaaacaagggcuuuagagaaggccgaacgcgaugcacugcucuccaaacuuaaucagcgaaagaaagccgcuuaugagucucugcggaaggccuugaaacuagacccagaugcacguuucaacaaggagagcgacaauagagaagauaugauuggagacgagaucgcggcugaaauggcccauaaguccagguucggcaaagucuggcuggguaugucagcagaggcccaggcucaagugauagaacgccuccgggggcuggagagugaugccgacgcagaugacuuugaggcuuggcuuagagacgaucacggacuggcccaggaacaggcgaaggccguaaccgcugcaaacuugcccgagggcuacggcagguucggggaaacggccacucgaaaacucauugcugcccuggagcaagagguuaucguguacagcgaagcaguccagcgcgcgggauuaggucaucacucugaccugcgggauggccagguguggaccgacaagaaagggaauccugcccuaccauauuacggagcugugcucgagagacacauuguccccggcacagccgauccgaacgaaacugacgaugcacugaggaucggucgucuuaccaauccuacaguucauaucggguugaaccagcugcgccgggugguaaaugcucucaugagaagguauggccaaccccaggagauugccauagaacuggcacgagagcuuaagcuguccgacgaucggaagaaagagaucaacacccgcaacagagaaaauaggaaggccgcugagaaacggucacagaaguugcgaaacauuggacaggcggacaaaggcgggaauagagcccuccugaaguuaugggaagaacugaacccagaaaaugugcuagauagaaggugugucuacacgggacgugugaucagcauagacaugcucuuuaguggugcagcugagguugaucacauucugccuuucucugugucccuugacgacagcaacggcaaucggaucuugugccugagagaggucaacaggaucaagcgccaacgaacucccugggaagccagagaugaccuccgggcccauuuugggccagaugcuggaugggaggcaauugccgcgagggcugcccgccugccccgugaaaaacgcuggcgguucgagccugacgcagccaauagguuugaugcucagggcgguuucuuagcacgccaccugacagacacccagcaucuuucgcgauuggccagaucuuaucucuccgcgcuguacccagaaacuggggagggcucaggacacguguggguaaguccgggccggcuaacagagaugcugaggcgcgcuuggagccucaaccaccaucugcccgaucacaauaucgccggggcagccaaccagccuaagaauagaaaagaccauaggcaccacgcuauugaugccauaguuguggcacuugcugaccgggccauguugaaccguaucgcgcgcgaauccggaaaggagggucaugaagccgcaggccgacuggucgcuucuauuccagagcccugggagggguuuagcgaugaaguggguagagccgucagggcuaucaccgugucacaccggccugaccauggcacggcaaguaaagccggucgcgccaaggauaaggacgcuaccgcggggagauuacacaaugagacagcauauggccucacuggagaaaaagacgccaggggccuggauaucguugugacccggaagccacuuuccgcuuucaaaaagagcgccgaccuggaugcaauucgagacgaugacuugaaacaaaagcucaaagccugggcugcggggaaggagggaggcgccuuugaacaggcaaugagaucuuucggugaucccgagcgcgggccgaggucacauccuggacugcggcguauaagaguaacagagccacuaagugucauccccauuagggaccgcgauggccggccuuacaaggcuuacaaaggugacagcaacuaucgauuugauaucugggaacugaagacuggcaaauggaaggacgaggugguuuccauguucgaagcccacagacccaacuggaccucuccaauuagggcagggaauccuacagcccgcaaagugcucucgguccggcagaacgacgugaucgcuauagagagagaaaauggacccgagcugaugcguguagugaaguucagcgccggcucccuugcguuggcaccaccgcaggaggccgggucacugaaggcuagggaugccgacaaaaacgauccuuuuaaguacguuuauggaagucccucuagcuuacaacgguggaaagcucgccagguccgaaucgacgaacucggcagaguguucgauccagguuuugcagugaggucccggcgcucaagcgaguga

SEQ ID NO: 2746 - RNA, 3291 nt, Artificial Sequence
  Cas9 variant
augaagaacaucuucagcuuugacauuggcaccaauuccauagggugggccgugcuggcucucgauggaaacggugaccccgucagaaucgcagaugccggcguuaggauuuucucugacgggcgggauccuaaaucaaaggcgagucuugcugaggcccgccgaauggcacgugccaugagcagaaggcgggaccgcacacugagaaggaaacgggcuacuuugcgcacguuagcagaaaucggacugaugccagauaccuccucugcccgacaggcucaacuaagagagacaucggacccgaagucaggcagcggucagcucacuaggaaucccuacgcccugcgggcgcuugcacuggaagagaaauugccucucuuucacauugggcgugcccuguaucaucugggacagcgcagaggcuuccagaguaacaggaagaccgaucggaaggacaaugauaaaggcaagaucgcucucgggauagaagaguuacacgccgcaaugcgacaagacggagcucagacauacggucaguggcuggcccgcagacaugcgcuuggccaggccgugagguugcgguccggggcacuggaucuagagggagaaggcuaugcuuuuuacccagagcgcaaacuccuggaagacgaguuccacagaaucugggaggcccaagcuaggcauuaucccgacauucuuaccccugaacgucgggaucaccuguuuacuguaauguucuuucagcgaccauugaagaaacccaagguggguaagugcucuuucaacaaucaggaggaaagacucagcaaagcccacccucuguuucaggaguucagguuauacaaggaagucaacgagcuggagaucguggaaccagaccucacacauaaaaagcugacccuggaucaacgcaaugcauugguuaaaaagcuacaggugucccgggaggccucauuugcugcgcugagaaaaguccucaagcugaggccggaccagcgccuuaacaaggaaagugagagccgaacgaaacugaaggggaaugaaguguaugcaguauugucugauaaaacucgguucggaccccguuggggcaccuucucccaagccgagcagugggcuauuaucgagagacucaaggaagaggaagacccuggcaggcuguuugccugguuacgcucagcauucgggauagagggagaacaggccgcugauauugccaacguucaccuuccagagggucauggccggcuagggaaaacagcacucgaggcgaugcuggaggaacuuaaggcugaagugaucacugaggccgaggcagccaagagauguggauacgaccacgcuagguugggcggugggagcgaugaaggcgagcccgaacugccuccauaccaggagauucuccaacaccgaaucccgcccggaaccaauaacccugacgaucccuaugacaucgaaaaaggccgcuuuacaaauccaaccguccauauugcccugaaccagcuucggcacgugaugaacacgcugauaagaagguacgggaagccugcacagaucgcuguggaguuggcccgugaccucaaacugagugagcgccagaaggaagaggucaaucggacuauugcgagaaacacaagggaugccgaacgacggggaaaaaccuuagaggaaaaucgcauccccaacacugguuauaauagaacacugcuaaggcucugggaggagcugaacccaggcaagguugaagaccggugcuguauauacaccgggaagcccauuucuaucuccaugcuuuucagcggagagguggauaucgaccauauuuugccuuggucgcgaacgcuggaugacucucacggcaauaaacuccugugcuuaagagaagcuaaccgcguaaagaggaaucgugcaccagccgaugugaccgaguggcgggacaacuaugaugaaauccuguccagagcugccaggcuuccgcaaaauaaacgcgaccgauuugcacccgaugcgauggagagauucgagaaggccgguggguuuuuggcucggcagcucacagacacucaguaccugucaaggauggcccuagaauaucuggcaugucucuucccugcugaggaaauggauggcuuuggagagcugcgccgucauagauacauuaacgucugcccaggccggcuuaccgagauguugaggcgcaauugggggcugaacaguauauuaagcgacucccagcucggagaaacagcccaagagaaaaaucgaaaggaccacagacaccaugcaaucgaugccauugugaucgguguuacuggccggucucugcuuaacaggaucagcuacgcugcggggcgccuggaagcccagcaguuggagacccucgugaaggaagcagcugccacaaacaaacccugggacggauucagagaggaugucgccaaggugguaggcgguauuauaguuucacacaaaccugaccaugggaccgcuggcaggaaggcaaaagauccagcccggcagcaaacugcgggacgucugcacaaugacacggcuuauggccuaacaggggagaccgaugcccgcggaaacacuaucgugguccgaagaaagcccuuucugagucucaccuccaaagacauuccgagcaucagggaugaagcacugcgggccgugcuugagcagcacuugcgcggcauuccugacgguaaggcuuuccaggcagcccuggaugcguuuagaaagcaaaaaggguuccaucacuaccauggaaucaggcacguccgguuaacagaaccacucucugugauaggcaucaaggaccgagaugguaaaguuuauaagggcuacaaaggggacgcuaaucagagauaugacgugugggagacccuggauggaaaguggcaugccgaaguagucucaauguucgacgcacaccagcccggcuggcagagucgcuuucacgccgagaacccuacugcuaggcgggugcuucgucugcaacaggaugacaugguugcccuaaaugcacccgaugggggaagacuccuggugagggucgugaaguuccgccagaacggccagauuacauuugcuggucauaaugagagcgggaacuugaaagcccgggacgcggccuccaaugaacaagauccauucaaguacaucucucgaauggcaucgagccugaaagacuguggaugcagacagguaaggauugaugcuacgggccagguguuugacccugguccccaggaucgcgccucccgguuacaaaagcagucaaaaagauga

SEQ ID NO: 2747 - RNA, 3294 nt, Artificial Sequence
  Cas9 variant
augaagaaacagccccaaagauacauccugggacucgaccuugggauugccagcgugggaugggcucugauauuggucgauggugcagagaacccuguuggcuuacuggacugcggggugaggaccuucgaacgggccgagguaccaaagacaggagauucccuagcgcucgcucgccgacaggcccguucugugagaaggcugauccggcgcagagcacacaggcuucugcgguugcgccgacuccugaaaagagaaggcauucugucagccgcugacuuuaauagugauggucucccgaacuuacccaucgacgcauggcagcugagggucgccgggcuugagcggaaguugacuaaucaggaaugggcugccgugcugcuacaucucguuaaacaccguggauaucugagccaacgcaaguccgagacgcagaccgagaacaaggaacuuggcagacuguuggcgggcguggcagaaaauucuaaacuccugucggaaucaagcgagcaguacaggacuccugccgaguuagcugucaagcuguucgccgaacagagugggcaucuccggaacaaaggaggugaguauacacacaccuuuaaucgacuugaucugcaaaaggaauugcaucuacuguucgagcgccaguacgcacucggcaacccauuugcuuccgccgaacugcagucuaaaguggacgagcuucugaugacacagagaagcgcguugcaaggggaggccguacucaagaugcugggaaaguguaccuucgaacccuccgaguauaaagcagcuaagaauacuuacucagccgaaagguuuauuugguuaacaaaacugaacaaucuacggauccucuauaacggcgaggaacgcgcucuggaugagggugacagaaagaaacuuuuggaugagccuuacaagaaagccaagcugaccuacaagcagguuaggaguauacucaaucugccagaaagcgcaguguucaaagggcuucguuauggaaaggacucugauggccugaaagccgagaacggcacguugauggaaaugaaggcuuaccacaaaauccggacuauucucgacaaggcggggcugaagggagagugggaaaaucgaaucagaaaccccgagauuuuagacaaaaucgguaccgcauuuucccuguauaagacagaugaggacauacaggccgcucuagccgaucucaggcugccugaaaacguccuugacgcauugcuggccggccucaauuucgauaaauuuauucaacugucauuaaaggcucugcgcaacauccuuccauugauggagcgggggauuagauacgacgaagccugcaaagagguguauggagaucacagggcacucgcggagagcaagaaucaggugcugcuaccgcccaucccugcugacgaaauccgcaacccagucguucugcgaacucucacccaggcccggaaggugauuaaugcaauaauccguagauacggcaguccccagaggguacauauugagacagcccgcgaacuggguaaaucuaagcaagagcgggauaaaaucgacagaaagaacaaagaaaaucagaacgauaggaaucgacuugcuuccgacauacgcaagcacuucaacuuugagccuaccccaaaggacauuuugaaacugcgguuauaugagcagcagcaugggaagugucucuacagcgaucugagagaagagaaaggcgaaugccuuuacacgggaaaugugaucgagcugcacagguuguucgaagacggcuaugucgagaucgaucacgcccucccccugucgcguacuugggacaacucucuaaauaacaaggugcugguucucaaauccucaaaucaaaacaaggggaacaaaacaccguacgaguggcuggauggagcaaauaacagucgccgguggagagaguuccaggcuagggugcaggguugucauuuuccuuaugucaagaagcagcggauucaaaccgccaaacuugacagcaaggcggagcagggcuucuuggaacgaaaucugaacgauacucgcuacaucuccaaauuuaugugccaguucauuacagccaauuuaagacucgcugagaccucuaacgcacugauggaagagguggccggggagaaucccuauuggaaggaaaggaaacggcagcgaguauuugcuccaagcggaucaauaaucgcccuucugagaggccuauggggucucaagaagguucgcgaggacaacgauaggcaccaugcacuggacgcgauuguggucgccuguaguacgguguccaugcaacagaaaaucaccaaggcuaugcagcgucgggaaacauuggagacugucgauagcgagaccggggaagugaaaacaagaaucccucaacccugggacuucuuuaggcaggagguuaugauucgcguguucucugauucaccacgagaggaacuggccgaaaaguuaaauaguagacccgaggcacuccacgacuuuguaagcccucuguucgucucccgggcuccaaacaggaaaaugacuggccagggacaucuugagaccgugaagucugccaagcgccugucggaaaauauaagcguugugcguaaaccguugacagcacucaagcugaaagacaucgagaacauugucggcuaccccgauagagaaccugcccuauaucaggcucugcgggagaggcuucucgcgcacaaggacgauccagugaaagccuuugcagacaagcccuucuacaagccugcuaaagaugggggacaagguucccugguaaaggccgugcgcaucauugaaaauaccaaacacggcuugaagauccgaaacgggauaacugacacgaauggagauaugguuagaacagacgucuaccagaaaaccgauaagaaaggcaagcggcaguauuuuaucgugccaguguacgccuggcaggucgagaagaacgagcugcccacuguugacugcaaagguuaugaaauugaugacaacuacgaguucuguuucucauuauauaaguacgaucucaucgaaauucaaaauccgaacgacaucaaucaggagcugagggcuuauuacauaaacugcgacaguucugaugggcgcuuuuggcuugcauaccaugacaaaagcgccaaggaacagcaguucagaauuuccacccaaaaucagccuaucauuaaaaaguaucagguggauacacugggcaaggagaucagguuguguaaagcggagaagcggaccgcucucaacggcaaaaagaaaaaguga

SEQ ID NO: 2748 - RNA, 3294 nt, Artificial Sequence
  Cas9 variant
augggcaagggggacauccuguucagcuuugauauuggaaccaacuccauagguuggugcguguucgcccucucugacaauggcgaucccuguagaauccuugacgcuaacgcaaggauuuuugccgaugggcgggagccuaaaucaggaaauagucuggcggaaggccgccgagcugcccgugcaauggccagaaggcgggaccgcuacaagagaaggcggaaagcugucuugcgcacauuaacugaguauggucugaugccagcagauccgaaggcccgacaggcucuaguugccaaaacgggggacagaggacccaagagcgaagaggcgcucgcagauguguacucccugagggcccgggcucuuauggaaaagcugccuuugcaccauaucggccgugcccucuuccaccugaaccaacgcagaggcuuuaaaucuaauaggaagaccgaccggaaaucgaacgagaagggggcaauugagacaggaguaaaucgacugcucgaagagaugcgcgauacuggugcuccaaccuuaggcgccuaucuggcgaaaagaaggucagacgggcggcccgugcgcgucagagccggagcaagcgaacaggaggcugaggauggcaagccugccaagacagcuuacgacuucuauccagugaggcgucuuuuggaagaggaauuugacgccaucugggagaaacaguacaguuaucaucccgaaguucugaccgaggagcggcgaggucaccuauucagagugauguuucaucagaggccucucaagccagcaauagucgggcgcugcuccuucaacucugccgaaacucggcuggcuaaagcgcacccgcuuuuucaagaguucagacuguacaaggaagugaaugaguuggaaguaguuaugcccgaucagagccacaggaaacucacacugccugagcgcgaccgauuagugcugaagcuccggggacagcguaaagcaaccuacgccgcucuuagaaaggagcugagguugcgcgaucuacgguuuaacaaggaaacggagaauagaacugacaugaugggcgaugaagucaccgccgcacuggccgacaaagcuguguucggcaacaggugguccggguucucaacagaugagaaguggcgaaucguggaacgccuccgggaggaggaagacccauuugcccugcaugaguggcuugucagugaacacggacugagcgaugcagaggcggagcaggcugccaaaguucauuugcccgacgguuauggcagacucgggccuacugcagugucuaccaugcuggaagaguuaaaggccgauguaauuacagaagcugacgccgcaaggcuggcuggauacgaccacucccuagcccgugcggaugaggacggccucgaucgccugccaaaauaucaagaagugcuugagcggagaaucccgcccgguaccaaugacccugaugaccccuacgauauugccaaggggaggaucacgaacccaacuguccacauagcuuugaaucaguuccgacaugugguuaacgcacuggcccggcgcuuuggcaagccugaccagauugcuaucgagcucgccagagaacugaaacuuaacgauaggcagaaggacgaggugaaucgggucauuggacgaaacacaagagcagcggcccugcgcucacaaaaauugagggauaucggccagaaggacaauggguauaaccgugcucuccugaaauuaugggaagaacugaaucccgauaagccagaagaccggguguguguauacaccggaagacccaucugcauuagcaugcuauucaguggugagguugacguggaucacauacucccuuggucuaggacuauggacgauucccaggccaaccgcauccugugugucguggaggcaaaucgagucaaggcuaacagagccccagcagaaguggccgaguggggcgggcgguaugacgaaauucuugagagggcugcgcgcuugccgcguaauaaaagauggcgguuugccagggaugcaauggaaaaguacaaagagaacgagggauuccuggcucgccaacucacagacacccaguaccugagccgauuagccagagaauaugccgaggcucuguaccccacggaggagccugaucggcuuggcgaguugaggcgcagaaaucauguuagggugaucccaggucggcucaccgaaaugcugcgucgcggguggggccuaaacgcacugcuccccgaccacaauuuuggagccggccaggcgaagaaccgaaaagaucauagacaccacgcuauagacgccgcaguagucggggugacaacuaggggacugcuucagcggauuucgaccgaggccgguuugcgcgaaaagcuggcuuuagaggaaacaaucgcagauaucccuaugccauggcccggcuucagagaggagcucaaggccgcgauugacagggcuguugugucucauaaaccggaucacgggacucugccuaagccaggagaacauggccggaccgccggucaacuucacaaugacacagcauaugggaucaccggcgagacugacgcccgaggaaaccccauugucgugagacgcaaaccuuuucuguccuugacggauaaggacauacccucaaucagggauacagaacuccggggccguguauacagugcuaccagcgggcuguccggaagagagcuaucugccgcacuggacuauuucaggaaaacugauaagcaguuucgcggcauucggcacgugcgaguuaccgaaagccucucagucaucccaaucagagacagggaugguaacauuuacaaaggguauaagggagacgcuaauuuccgcuacgaugugugggagcugccugacggcaaguggaaagccgauguggucacaauguuugacgcgcaucggcccgacagagccgcagaggaacguaggccacacccggcugcccggaagguucuuaguuugaaacagaacgauaugguggcuugcgagcauccuaaggacgguuacaccauaggccgcgugguaaaauucaauacugcagggcagaucuauuucgccgcccacaacgaaggaggcucccugaaggcucgagaugcggacagagcagaucccuuuaaguacuucagcaaaucugccucaggguuaaaggagauugcugccaggcaaguccggaucgacgcaacaggacaggugcucgauccaggcccccaggaccgcgaaaguagacuggccaggaauaaacgacuugagcgggagcgugcuuga

SEQ ID NO: 2749 - RNA, 3303 nt, Artificial Sequence
  Cas9 variant
augaaguacaccaucggccuggacauugggacaagcuccgugggauggggugucauagauacugagagaaacaggauccaggaccucggcguucggcuuuucgaaucugccgagaaucaaaaagauggggaaucacuggcuaagccccgccgagacgcacguaguaugagaaggcgguuggcccgcagaggaagcagguuagagcgggugaaauccauuuuugaaaaggcgaaauuccugacgcgcggccagauggguaucacccacgcucgaccuaacgauccauauagacuaagggccgaggggcucgaccggcugcuuucuaaugaggaucuguuuauugcaguauaccauuuggccaagcgucgcggauauaagucgaacagaaagaaugugcucgaaggcgacggcgaggaugucagggaagggaaggcugugcuggacggaguugcacagaacaaaaagcugauggccuuccgggguuaccgaacagugggcgagauguuuuucaaagauucagucuuuacugaggcuaagcgcaauaaggccgggagcuauaaacacugcgugcucagagaaauguuagaggacgaacugggaaagauccuucaugcgcagaggaguuugggcaacacccugguaacagauuccuucauaucuaaacuacucgagaagaaaaccgguguuuuuguguaccaacggccguucgcaagcgggaaucagauccugaaacuugucggacccuguacuuuugaaccugaggagauucgcgccgcuaaagccacauauuccuuccaguacuuuaacgugcugcagagauugaauaaccucaccaucaagaauacggacacuggcaccgaaaggaagcugacaucagaggaacgugcaaaaaugauugcuuucaucuucagucacaaggacgugcaauacgcccagauacgguuagagcugaaacucagcgaugucgaccgauuuaacaugguuaauuauuucgugcagagaaaggaacuugagacuaaaaccgcggaggaacugaggcgcgagauugaaaagaagacaaaauuuccaucuuuguccgauuacuauaccauccggaagacgguaucagagauugacagcgccuucuggauccagaucgaaaaacaacaugaugugauugacgcaauaggcgagaucuuuacucuauacaagacagaugaggacauuaucgcucagcugaacaccagaauacccaguauuccuaggccagucgugucugcccuccuggggcuuuccuucacuaaauuuggacaccugagcuugaaggcucuccgcaagaucaucccccaccuggaaaacggugauacauaugacguugccugcgcaaaagccgauccuaaguacaccgaccgagcuaaaacgcgggcgcguaaguuaagaccacuggacaaagaggaucauucgauuaccaauccgguggcaaggcgcgccaucgcucagacaauuaaggucgugaacgccauaaucgacaaguaugauucucccuccgaaguacacauugagcuaggccgggaccucgccaaaaauuucaaggagagaaugaaaauccaaaaggaacagaaacagaaccaggaggggaaugaaagggcaaucgcuaagauucaugagcuguacaaacuugaaaacccucgaggacaagauauaaucaaguuucgcuuguggaaugagcagaacggccaguguauguacucaggugagcggauugacgaaaucagacuguucgauaauggguauacugagauugaccacaucauaccauuuaguaggagcuucaacgauuccuacucuaauaagguucucgugcugaaaaugcguaaccaggaaaagaugaauaaaacccccuaugaguacaugggcggagacgccgauacauggcaacgcuuugaaaaccuugucaauagcaugcacaacaucggcccucggaagaaacagaaccuguugcucaagaaguauguggcagacgaucugacuuuaagaacccugaaugacacaagguucauugcgcgauacaugaaaaacuauaucgagaauacccuacucuucacugaggggccacagaagcagcgggucuacacggugaacggacaagcuacagccuaccugcgcaaaagauggguucuucauaaggacaggaccgaaaauaaccggcaccaugcacaggaugccgugguagucgcuguggccacucccucauugguucaggguauuaugcgacacgcaaaaaugggcgagaucguggacuaucugcauagucagaaguuugcuccgaaugucaccgauauagaaacagggaagccuuucgaguccgccgacauucaaagcgcgaaagaaagaaucauugccaagcacgagcaccgccucaggauccccgagccaugggaaggauuuucugaugagcuggacgcucguaugggcgaugacgugguagaaaaauuaucacugcggaagaguaacauacaugguuacaaaaccacuagcgauuucucccagauccacccuauuuuugugucuagaaugcccaagaggaagacaacggggcgcgcacaucaggagacccuucgaucgccaagacgguucaaagaguuucaagaaagcguugucaggacucccuuguccucaaucaaucucaagaaacuggaggaaaugaguggcaagaacucugacaaacuacuguaugauauucuccgcaagcgucugcuugcccacggagacgauccuaaaaaggcuuucacagagccagugcacaagccgagaaaagacggcacccaggggcccuuggugcggagcaucaagauggucuccgaaggacagaggucagguauacugguuaauaacgagcaggccuuaguggaccaagauagcaugauucgcaucgacaucuuuucuaaaccuaauaagaaaggcaaggaugaguacuauauuaucccaguguacgcauaucauuucgcgcagaaggaacuccccaacaaaguaauuacagccaaggcugaggccgacuggcgaacuauagaugacaccuuugcauucgaauuuucccuguacccuaaugaucuugucaaacugacgaagggggacgauaucagauucggauacuauaguggcugcaaccgggcuuuggccgcaauucacauccucccacaugaccagaacaugccccuggugaauaacgguauuaaaacccuagauaagaucgacaaguacguuguggacauacugggggaguaucacaaagucggcaaggaaacaaggcagcaaauccaguga

SEQ ID NO: 2750 - RNA, 3303 nt, Artificial Sequence
  Cas9 variant
augggcgccaccaucgugacagacauuagcagauccgcuuucgcauuugauauagggacuaagucuaucggaucagccguccugaggcucgacgaucggggugagcccauuggcaucauuaacgcggcuguucgcaucuacgccgacgggcgagaaccuaaaaguggaacgagccuugcagagggccguagacuggccagggguaugucccggcgcagagauagguauaagcggcgccgaagaaccuuguuaaauacacugacugaguucgggcuaaugccaccgaccgacgaggcuaggaaagcacuccuggccgaaacaaacgaucggcguuuuggagcuguggccggcaauguauacgcgcuucgcgcaagagcccuggacgagaaguugccccuccaccaucugggcagggcucuguuccaccucaaccagcggcgaggguuuaaaucuaaucgcaagaccgauaagagagacaacgaucaaggaaaaauagccucggguaucucaagguuaggccagaagcuggacgaggcaggggcucggacucuuggagaguucuugcaucgccagcacagcgccggcaaaugggugagagucaggccuagucgugugccauccaaggaugacaaagaagaagacgguuauggguuuuaccccgagcggucuuuccuggagcgagaauuugcggccauuuggaaggcacaggcugccuucuauccugagcuacucacagaagagagaggagaucaucugcacaggguuauguuuuuccaacgcccacuuaagcggcccaaagugggcaagugcagcuuuuacccugacgaagauagacugccaaaagcucacccguuguuccaggaguucaggcucgucaaggagcugaaugaauuagaggugguacaucgcggcgaccgacgggaaaaacugacccucgagcagcgugauacgcuuuuuaaccagcugagaacucaaagguccucagccuucaccgcauugcgcaagacacuaaaagcccccacugggacccgguuuaauaaggaaagugacgcuagagauaagcugaaaggagacgagguugcggcagagaugagccacaaggauagguucggucaggccuggaucggcaugccucucgcugaacgaugggccgugauugagaugcugcuugacacagaagauccacuggaggucaaagcaugguuggaagaacauuauggguuugccgcugaccgcaucgacgccauagcagcggcuaagcuacccccuggauacggccggcugggugagaccgccuuaagagauaugcuggacgaacucaaaaacgggacggugaaggaugacucuggcagggaugugguccucacugagcgucaggcaauggacaauauuuggaaggauaacccagcccugcagcgcguuguggcugacgcccgggaacuucccccguaccaagagguauugggaagaaggaucccucccggcacagggaaaccagaggauccuuaugacgugcagaagggacgacugaccaaucccacuguccacauuggucucaaccagcugaaacgggugguuaaugcacuugugcgcagacacggcaggccagaucaaaucgcucuggaauuggcccgggagcucaagcugaacgaggaacagaaagcggaaaaggaccgagagaucgccagaaacacaaaggcugcacaggcccgcuccgagaaauuaaggcagcuggauauugacgacaauggguacaaccguguccuacucaagcugugggaagaucuuaauuugcggcaacccgagaacagagaauguauauauugcggaaaagcuaucggcauugguacccuguucucaaaucagguggacaucgaucauauacucccuuggagcaagacgcuggacgauagucaggccaacaggauuguaugucacguugagugcaaucgccagaaagggaaccaugcaccagcggaagugccgcaauggcacgaccgauacgaugacaucuuagccagagcugagcggcugcccaggaauaaggccuggcgcuuuggccgugaggcaaugaagaaauucaaggaugacgaaucuuuucuugcuagacaguugaccgauacacaguaucucucccggauggcccaugaguacgucgcagcccuguauccugacgaggaaccagaugaauggggaguguucacuaggcgcaaccacguccgagugauccccggcagaaugaccgagaugcuacggaggcagugggggcugaaugcuauuaucagcgaccacgaccagaaaaaccgcaaugaucauagacaccaugcgauugacgccauaguugugggaguaacaacuaggcggcuccugcaacguaucgcaaccgcugccgguggccgcgaggcccuugcuuuggaagagacaauugggaagaucgaaccuccauggcccggauuuuacgaugacgucaaagaggcaaucgaucgaauugugguuucgcacaagccggaccacggcucucugccuaaaccaggugagcccgccagaaccgcggggcaguuacauaacgauacugcuuacggcuucacgggagaagagaggaagggcgugccuauaaugguccaccgggugcccuuugccacacucaccgaaaaggacaucccauccauucgcgauagacagcuggcagaggcccuuuauggggcuaucgcaggaauuucaggcaaagccgaacuggcggcugccuuggcaagguucagugccagcgguccuuacaaggggauccggcauguacgagugguugagcccgucuccgugauagcuaucaaagacagagauggaacuccauauaagggcuacaaaggugacgccaauuaucgcuacgacgugugggagcucccgaacggcaaguggacccacgaagucguuucuauguucgaugcacauaggccugacuggcaaagcgagauucggaacaagaaucccgcugcccguaaagugcugucacuacaccagaacgauaugguggcguaugaacacccacaggacggguacacaaucggaagaguagucaaguuuggcagugggggacaaauggcccuggcaggcaauagggaggguggggcucucaaaucccgcgaugccgaccccgaagaucgguuccgauacuuuuauaagagcggaggcgcuaugagagacgcaaggcugcgccaggugcggguugaugagaccgguagaguguucgacccuggcccacaggaucgugagucuaggaacgcccggaaacagucagccgcuggguga

SEQ ID NO: 2751 - RNA, 3306 nt, Artificial Sequence
  Cas9 variant
augaagacccugggccucgaccuugggacaaacagccugggaugggccaucguggagacuagagaugaacccacgaaauacuccgaggguucuauugucgcuucaggcguuaggauauucagucagagcgaaauggcagggcgggacccucaauccaaggccucuuuggcgguggcucgccgacaggcccguggaucgagaaggcggcgcgauagauauuuaaaaaggcggcagcgccugguagaccuacucguggaucugggccuuaugccagcagacaaggccgcucgagcagagcuggucaaaaaucacggugaugggaagaccggagacuugucaagcaguguguacgcccucagagcuagggcccuggaugaagcgcuguccccguaugagaucggccgggcaauuuuucaucucaaccagcgucgcggcuucaagucuaauagaaaagccgacagcaacgaucccgagcaagggguuaucuccgaaggaaugagggcuuuagacgagaagauggccgaagcuggugcacggacaauuggcgaguggcugcacaugcgacgccuucagggguugccugugagagccaggaucgcgccagauggagagggcuacgccuuuuaucccucacggggugcacuggaacgcgaguucgacagaauaauggcuaggcagacucuauuucauaccgaccuccugacagauaccgccauccgugaacuucgggaggucguguuccaccagcgaccucugagaccaguaaaacccgggaagugcaguuacaauccuuuggaagagaggcucgcuaaagcccauccacuguuucaaaaguuccgcuuacugaaggagcucaacgaacuugagauuguuggagaagaccagaaacacaucaagcugacuccggagcagcggaaugcauuggcccuacagcugagaacaagccucaccaaacaaggcaaggugcccuuuucuaaacugagguccacgcuuaagcugggccgcgaaguccgauucaacaaagagacugauaaucggucagacuuggagggggaugugauuuauuuucguaugagcagaccugaauguuucggaaacaggugggcugaccucccaguggagaugcaggcggcaaucaccgaacgccugcggacagagcccgauuacaagacuuuaaugaauuggcugaaggccgaaaccggucuagacgagguccacgcuagagccguugcagauacaccugugccagacggcuuugggaggcucggacagagugcccugaccgcucuuauagaugccuuggagaacgaaguaggcgaggguggguucgugauuacggaagcagaggcggcuaaacgagucuacggccgcacuaauucugaggccgaccccgaccggaagggaguggaugaacugccgaaauaucaagagguucucgcaagacauaucccucccggcacaggggaaccagacgauccuuacgacgauuucaugggaaggauuaccaaccccacugugcacaucgcccugaaucagcuucgucgcgucgugaacgcucugauccggacauaugguaagccagacagaauugccauagagguaggcagggauuugaaaaugaacgaccgagaacgggaugagguuaaucgcagaaucgggaggaacaccaaggcagcuauugagcggggagugaagcucacggaaaccuuucgacagcuggacacaggcuacaauagauuacgccuggagcuaugggaagaucucaaccagaaacccgagaauagggucugcaucuauugugguaaggccauagcggggcauaugcuguucaacggcgaaacugacauugaucacauccuuccuuacuccaaaaccuuggacgacagcaaggccaaucguauccugugcuguacaucgugcaaccgggagaaaaagaauagaccaccgucuagggugccccaauggcgcucccgauauggagagauucucgcuagagcaacuacccugccuaagaacaaacaguggcgguuugccgaagaugcuaugacaagguucggcgaggaagagggguuuuuagcccgccagcugaccgacaugcaguacaucucacgucuugcauugacuuaccucgcgcaccuguaugauuacgaagaggucgaccuagauggaauuuauaagagacaugcccgggugagggcucugccaggucgcaugacggagaugcuccgaagacaauggggccugaaugaacuuuugcacgaccauaaccugauagggggagauguugccaaacccaagaaucgguuagaccacaggcaucacgcaaucgaugcuauugugaucgccuguacaagucgcgcacucauccagagacuggccaccgcuagcgcggccgcagaggaaaggggcgcugagcggguagucgagcguauugacccuccaugguccgguuuccgcgaagaugugcgagccgccguuggggcuauaguggucucucacaaacccgaccauggcacugugggaagagagggcuacgcaaaggggaggggacagaccgccggcaaacuucacaacgauacagcguauggucauaccggggaaaaggacgcuagcggaaaugacaucguagugcggcgcauugccguuacugauaucagaucaccggcagacauuaggaagauccggacaaacgcccacggccacagugagcugcgagauagauuguacgaagcuacgcgcggucucgagggcaaagcauuugagcaggccguccuggacuucgugaagggggaugcgaaauuuaggggaauacggcaugugcguaucaccgaagucgcuaacccuguuuggauuacucacggcgacgggagacauaagaaaggauaucuaccaggcgguaaugauagguucgacgugugggagcuggccgaugggcgcugggacgcagaagugguaacaaccuuugaugcccaccggcccggauucgucccucgaaugagacucgagaaccauaaugcuaggaagaucaugucccugaagaaaggcgacaugauugccuacaacgaccccgugagcggucaacgcaucauagcaauuguucggaaguuugaucagagaaauaaacagcuuuacuuggacccacacaacgaagcuggcaaucuggaucguagggagaaggagaaaacauauaagccuuuacggcccaugccaaacccgcucaagaaauaccgcccucgacaggugagaaucgacgaaauugggcaagucuucgaucccggaccauggugggagaggcaggacggcuga

SEQ ID NO: 2752 - RNA, 3306 nt, Artificial Sequence
  Cas9 variant
auggagcagaccagccuggaccucucccaagccaugaagaaaguggcucagccccagaagccuuacagacuuggcgucgauguugggguggcaucuaucggagccgcggcuguaacagacacugaaauucuggguauacacgugaggacguucgagaaaggcgaaaucaacgggaagucaggacggaaaccauugaaugccgauuaucgccgacagaagggccaacguaagagauuaaggcggaaaaagaaccgccugcuaagucucagaaggcuguuucggcgcgucgguaugauugagagcgcagccaucgaggcuuucccgauuuccucuaccucgcccuggcagcuucgaacagaggggcuggacagaagguugacuaaugaggaaugggcacaggugcucuaccauaucgccaaacaccggggauuucagucaaaccgucgcguugauauggacgaggcuaccaagcugagcgaugccgcgggcgacaguccugaaacaaccacuaauacagaguccgauucugacaccaaaaagaugcuggcaggcguggccgauaacaagagacucuuagcugagaaaggguauaggacgauaggagaagccgucgcacgggacccaaaguucagccaucgaauccgcaauaaagaggaauccuacucacacacuauugguagagaugagaucaacgcugaacugaauugccuuuuucaagcccagaaccauuauggcaauccccacgcgaccgaggaguugagugaacagauuaucgaccugauaaacuggaggcggaagacagugacuggggacgauauuaaacgcaugguaggaagauguacccuagagccuaaggaauacagggccgcaauccacagcguuucugcugaggaguuccguuggcucuccacacugucacggcuucgaauugugacccagggcgaaagcagaccacugacgaaaugcgagugggacaaggucguggauuugcccuggaggcaagaagccaucacuuauacaaguauccgcaaugcuauuggucuccggcaugacauaagaucuagguuuaacauccgcuacgagaccgggggaaagaaaacuaagacagauaccaaaaaugaaacgaccaagggccaguccgccgacgcagugacaagcgaggucaaaacugccgaaaaggagaccgcuuucaaggcgaaaggcuaccacauucugcgaaaggcauauaaagccuuuggguacgaugagcagugggaccgggaucguuucaacacagaauuacuggacacucucgcuaccgccguuacauuuuauaaggaugacucggagauccaagcacaucuugaaaccaacgacacuccugaguacgccauacagauugcucugagauugccaacgcuaacaaaauucucuaagcuguccaauaaggccauccucaaaauccugccgcacaugagggagcgccagucauauaguaacgcaugucuucuggcgggauacaagaaucaccauaaacaguaugaugacacuccccaaaacgguaagauuccucggagcgcuaucgaacacauuaaaaauaccgugguauacagauccuugaaccaggccaggcgagugauaaaugcaauggucaaggaguacggcgccccacaggaagugcauaucgagcucgcucgcgauauggaaaagucugccaaaaagaaagacgagauugaucuguggaugaagaaacggaagaaaaagaacgacgaguuaagagaaagguuugggaagaaucugagccgugaugagcuacucaaauauaagcuguacgaagaacagaacggacaaugcgcauauucacuucagcccauccaguugggccgccugcucgaaccuaauuacguugagguggaccacgcucugccacggaguagauccauggauaacagcuauaauaacaaaguccuugugcugaccaagcagaauagggacaaaggugaucgaacacccuucgaguacuucggggaagaccaagagucuguagauuggaagcgguuuaccaacuggguugaaucaaacccgcagaugccucaggccaagcgcagaaaauugcucacuaagagucugcagaaaggcaucuuagacaauuucagcgcgaggaaccuguccgacacacgguauauugcccgagagcuaaagacgcucauagaacauuacauccugaauacccccgagagagagaaaacuaaguacgaacgcuguguggucauuucuggaaaacuuacagcucaaaugaggcaguuguggggcaucucgaaggcacgugaugugagcgaccggcaccacggguccgaugccgcugucauugccugcaucaccccaucaauggugagaaggauaacacgcuaucugcagcuccaagagaggagagcaaugccuagugcgcccggaaagggugacgaacauccagccguuguggcucgggccaucccccacgcaccuguaccauggccgacuuuugagcaugaucuggaggcugccuuagaaaaaguccuggugucuaggccccagagccgcaagugguccggcccuauucacgcagacaccaucuacggggagcacaaagaucaggaaacgaacaccguugccccaacacagcguauuaaacuuacucaauugaccaagucaaauuauaagaacaucgugggauacgacgaggaaagaaauaaggauuucauagaccagauugaggagcggcucgaaugucauaacuuuaauggcaaacaggcuuucgguacaagccagucucccaucuauaggauuaagaaaaacggggagcugggcccugaagucaagaaagugacuaucaagcuaccaauaaagaacuccguauuucgcauccgaagaggauacgugaaaaaugcgaagaauaguaccauuuauaucaacauuuaccaaaauacgaaaacaggcaaguucgagaugcaccccguuuacgccaaagaucugaccagcucugcaaacgcuuccaagucauuugaauauaguccggaccuccagcuggucgauacuauccggcgaggggacuacauagagauuacacgcagaaacggagaggugaucagcgguuauuacgccacccauaauaucucgacuuccgugcuugaauugcagccucacgacaccacagauucuaggaacaaucggacgccagccauuaagaccagccugaacaucgagcguuuccauauugacauauuaggccgcaaacgaagagucguuaggcgggcuaagaaugggcucgcagaugaccgcgauaaauga

SEQ ID NO: 2753 - RNA, 3309 nt, Artificial Sequence
  Cas9 variant
augggcuacagaaucgggcuggacauuggaauaaccagcguggguuaugccauccucaagacagaugagaaaggcucccccuacaagauugaacaccuuacuucugucaucuucccuauugcugagaacccaaaagacgggaagucacuggcaaugccgaggcgggaacagcgcggagcccgacguagaaauaggcggacgaaauuucgcaagcauagaaccaagauguuguucguuaggagugaguuacugacaaucaaacaaauagaagcgaucuauagcgagaagcagaaacuauccucuauuuacgagcuccggacuaaggcucugaacgaacgccuuaccaaugaggaacuguuucgaaucuuguauuucuuuucgggccacagagguuucaaaucaaacaggaaaagcgagcucacagagaaggauauggggcccgugcugaccgccauuaaagacaucgaagagaagcuggcagauggaacuuaccggacacucggcgaauauauggaguuagacgaaaaauaccaggagcauaagcguaauaaagauggcauagaccgcuaccuggggaccgccaagagaagucuuauugaggaugaaaucaaacagauuaucaucgcucaacagcaguuuggaaacacgaaguugacuuccgguuuccagguagcauuuauuggcgacgaggaacaaaccgggauauucaaugaucagagggaguuugaagacggaccuggcaagcagucuccauaugccgguaaccagaucgagaaaaugauuggggcuugcacauucgaggaaaaugagaagcgggcccccaaagcgagcuacacuuuucaauauuucgauuuccuguguaagcuaaacaaucucaaauaccgagaaaccaucggaggcgaguaucgcuuucugucccuugaacagaagaacgugcugaaggagaaagucuugacaacccagaagauaacguucucaggcgugaaaaagcuccuggacuuaccugagcacgcacaauuuaaucugguuaacuacgggacuaaaaguacagugaaggaaaccgagacuaagagcgucuucuaugccaugauuucuuaccauaaacucaagaaagcuaucccagcccccaucuuuuccaaucuuucaacagcagaacuggacgagauuggaagaaucuugacccuauacagcagugauaaggguaggaaaaacgaguucuauucucggcuggcuauuccugaagaggugguagaagcccuccugccaauaaacuuuuccaaguucggcaaucuuagccugaaggcgaugcgcaaaaucauuccguacuuggagauggggcucguuuauucggaagccgcaacgcaggcuggauacgacuuuagacacaagaaaaucgaucaggccuauauccacgagaacgugaccaaucccgucgugaagagggcugccucucagacaauuaaaauagugaacaauaucauucguaaguacggcgagccugacgguaucaacauugaacuggcacgggaguuauccaaaaauuucucagaacgaaagaagacugucaaauaucaagaggaaaacagagccaggaaugagcgcaucgcugauaagcugcgggagugcgaacuaccaguuaacggggcgaauauaaccagacucaaacuguuugaggaacagggcgaguucgaccccuacacaggacuuaagaucccuuuugauagggcauucagugaagaguacgagguggaccauauuaucccauauagcaaaacuuuggaugacuccuacggcaacaagauucugguaucugccaaggcuaaucaggaaaaagggaaccgcauccccauggaguaucuccagggaaagccggaacgaauaaagaagcuggagagcauuaccgccacaaucaaaaauccuaagaagcgggagaaacuucugaagcaacaguugaccaaagaagauguggacgguuggaagacucguaaccucaacgacacgagauacauuucaagucuguuacacgauuauuucaaucagaacaucuccuuugcaaaacuggagagcgaaaagaagaaaagggucauagccgugaauggcgcuaucacaucuaagcuacgcgcccgguggggguucaacaaaauuagagagaauggagacgaacaucacgcacucgaugcgcugaucguugcuugugugaccgacaaguacauuaaagagaucacuucauuuaguaagaggaaagagguccgauucaacgaaaaucuuuggaagcgcgagaagacaccccaggaaauagagcaagaagugguacacuuuaaaaaggauuaugaccggauuuucaaccaggccuuuccauugccuuggaccaauuucagagaggagguuagcugcaggauguccgaaaaccccgcagagcugaugaaaaaucauaccugggaaacuuacacagaugacgagaucgccgcucuccguccaaucuuuauugugcgcaugcccaacaugaagacgucuggcccugcccaccaggaaaccauccggucggguaaacuggaggagaagggguuaaauauuagcagagucuccauagaaaagcugaaacuugauaaggagggcacuaucaaaucaggaaacgcacaguucuacaaggacaguggcaauggguggcaauugcuccaugauaaacugaagguggcucuagaaaagcacgacggagaugguucuaaagccuuuccagacggcgucuucaaguaucaguaccuggacaaagagcauacagugaggaagguucgacucguggcgaaaagcacccugcagacaucccuuaacgagaagaagucaguagccgauaacgggagcaugauucggaucgacgucuuucgcaaugaacaaggaaaauaucaguucgugccgauuuacgcuaaggauagaguugccaaaaaguugcccaaccaggcaguggcugucggcaaaaucgccaaggaguggccucugauagaagagucugacuucaaguuuuccuuauauaguaaugaucucaucagggugaaacacaagaaagguguaaagcacgugagcaaagacgggaacaaggaagagaaaucuaagacugauuucuuuggcuacuauaccggagcagacauugcgacggccuccaucucaggcauuaguccaaauaacuucuuugaguuccggagcauggggcuggcuacccuuaucucgauagaaaaguacaaaguugauuacuuuggaaauuaucaucaggucaacgagaaggugcgacaaaaauuccccaagaauagaauguga

SEQ ID NO: 2754 - RNA, 3312 nt, Artificial Sequence
  Cas9 variant
augaaguacgacaucggcauugauauagggguggccagcgucggagaggcuguuaucgaccaggaagguaacauucuggaggcaugcuccaaucucuucgaugaagccgacgcggcuucuaacguggauagaaggaauuuucgggagggccgccgaaacaaacguagagaaaggacccggguaaaugacuucaagaaacuuuggacaaaguuuggguucgagauccccaaaaacgugaugaaugauacuauucuguugcgcaacaagggaaucaagugugaguuagaccugacggaacuauauucaguccuccuguacaugcuuaaacacagaggcauaaguuaucuggaggaugccaucgacgaagcaaaggguagcaauuacgccaaagggauugcuuugaaccaaaaggagcucaaagagaagcugccuugcgaaauccagcuggagaggcucaagauuuauggauccuaccggggcgauuguaucgugaaaaaggaagacgaggaugaauaucauucuaauguuuuuaccauaucggcauacaaaaaggaguuagagauucuguuccgcaaccagaaacuuccagaagaguuuauccagggcuacaugaagauuuucgaacgaaaaagagaguauuacaucgggccgggaaaugaaaagucaaggacagacuaugguguguacacuaccaacaaggacgaggagggccacuauaucacagauaaaaauauuuuugaaaaguugauagggaaaugcagcgucuacaaggacgaguuccgggccgcuggagccaguuauaccgcgcaagaauuuaacgugcugaacgaucuaaauaaccucacuguaaauaaccguaaacugacagagaaugaaaagaagaaaaucguugagaagauuaaauccucuaacgcagugaauaugcgcagcaucauaaagaaaguccuuggcgaggacauugaacaguucgguggggccagaaaggauaaggcugacaaagagaucuaccauaccuuugaaguguacaggaagaugaaaaaggaguucgagaaaaacggaaucgauauugccgacuucucccgggaaaagcuggaugagaucggcaauauuuugacgcucaacacugaaaccgagggcauaaagggggcacugcacgaagcuaaaaauucauuuacauauagugagaucgagacuuuaauugacauccgaaagaaaaacagcucucuguucuccaaguggcagucacucagccuuaaaaucaugaaugaacugauuccccagauguacgcccaaccuaaggagcagaugcaguugcuaaccgaaaugggaguguuuaaauucaagagugucaaguuuaaaaacucuaaguauauaccaguugaggaaaucauuaaagauaucuacaaucccgugguagugcgcuccgucagaacaaccauuaagaugaucaacgagacgauaaggaaauaugguuacccugacaacaucauuaucgagaugccacgggacaagaauagcacugaagagaaggaacgcauuaaaaaggagcagucgaaaaacgaaaaggaguaugagggcauccugaaaagaauaaaggaugaauacgacauugagaucaauagggaugacuaccguaagcaagaaaaacucgcgcugaaacuuaaacuguggaacgagcaggaggggcggugucccuauucuggaaagaugauuuccaucuacggcuugcucgaagauccucagcuguucgagauagaccauaucauuccaaaaucaaucaguuuugaugacagccgaaauaacaagguguuaguuuauagauccgaaaaucaaaagaaagguaacaauacaccguacauguaucugucuaagggggauaaaaacuggaauuacgaccaguauaagagcuacgugcuaggccucaaaaacaagggaaauauuucagauaaaaaggucaacaauaugcuguucauggaggacaucaacaagauagaugugcuuaaaggcuuuauuaccaggaacuugaaugacacucgcuacgccagucggguaguucugaacaugcuccaguccuucuuuaaugaaaaggacgggugccccacaaaagugaaggucaucagagggagcuucacccaccagaugagggugaaccugcgcaucaauaaagaucgagacgagucuuauucacaccaugcagucgaugcuaugcuuauuguguacagucaacgggguuaugaggccuaccguaagauccaggaggcuuguguugacuuugaaacgggcgaaauuauagaugaggaaagauggcagcagugcaucugggggaaggacuaugaucaagugauguacgaggccaaauggagcaagauuagggagaaaaucauugaagcagagaagaacguaaaauaucaccaucgcgucgacaagaaggugaaucggggacuguguaaccagaccaucuacggcacaagaauaaaagaugguaagaucuacaaaauuuccucuuauaauaucuacgacaacaaggaaugcgccucguugcucaaaaugauuaagggaggcaaggagagcaaaauccugauguauaauuacgauuccaagacuuauagggacaugauaaaaauuaucgaugaauacucagacgagaagaacccuuucguugcuuauaugaaagagaccggagacuacuuccgaaaguacgcgaagaaacacaauggcccaaagaucgaaaaagugaaguauuacaaagaggaagcagggaguuguauugauauaucucacaaguauggauacgagaaagguagcaagaaggucaucuuaggcucccugaaccccuaucgcacagacguguuuuucaaugagcggcuaaagaaguacuaucucauugggaucaaauacaaccauauuaagugcgaaggaaacaauuacguaaucgaugaggacgccuauaacggccugcuuagagaugcuggugugauaucacacgaaaauacuaucaacgacuuggagaaaguuggggucaaguaccuguuuagccucuauaagaaugauauuaucaaauacgaaaagaacggcgagauguucguggagagguuucugucucguaccauggaauaugccaauaacuacauugagacaaaaccuauccauaagccauucuuucagaaaaaggacaagaaaggaaauauaaagaacucccagaauuuagugggccugaguaaaaccaaguauauugggaaacuugucacugaugcauugggaaacacguacaugguugaaaaggagaaguucagccucaucguggacaucuga

SEQ ID NO: 2755 - RNA, 3315 nt, Artificial Sequence
  Cas9 variant
augaagcugauccucgcccuugacauuggcauagcuagcguggggugggcaguccuggauaaaaaguccgagaccguuuuggaagccggaucuaacaucuuccccgaggcgucagcugccgguaaucaggugagaagggaaaugcggcaagcacgccgaauuaaacguagacagaggacacgguuagacgauuuuaacaagcuguggcgcaaaaauaaccuaaguaucccucaguacaagagcacugagauuguaaaucucaaggugaaagcccugagagaagagaucucccuugacgagcuguauuugauacucuacucuuaucugaagcacaggggcaucucguaccuggaagaugcucaggacgauucacucagcaguuccaacgcauauacgaauggguuacgggagaacgccaaagcucuggaaaagcauuacccaugcgagauucaacgcgaccgacuucagaccaucggaaaauauagaggccagacacagauuacugaugacaauaacgagaagaucgauuugucuaaugucuucaccauaggugccuacaggaaggaaauuaaaaaggugcuggagacacaaaaacuauaccacaacgaacucaccgacgagcugugugaugacuauauccuuauuuuuaaucggaagcguaaauacuaugaagggccgggaaacgaaaagagccgcacugacuacggcagauucacaaccaggcuggaucagaauggcaacuauaucgacgaggaaaacaucuuugagaaauugauugggaagugcuccguuuaccccgaugaacuccggggagcggcagccucauauacggcucaggaguucaaucuguuaaacgaccugaauaaccucacuauaaauggucgaaaacuugaagagagugagaagcaugccaucgugcagcgcauuaagaccagcaacacagucaauaugagaaaaaucauagcagauuguaugggcgaaacuauugagaacuuuucuggggcuaggaucgacaaguccggaaaagaacaauuccacaaguuugagaccuacaauaagaugcggaaaucacugagcgaaaucggcacagauauugacgaguucagucgcgaugaguuggacaagaucgguuacauuaugaccauaaacacggauaaagaagcccuaauggaggcguuuaaugaaucugggcugaaccucgacgacuccgugaaggagugccugaucagcuucagaaaagccaauucgucuuccuuuucaaaguggcagaguuucagccuuaagauuaugaacgagcugaucccugaaauguauauccagccaaaagagcaaaugacuuugcucacagaaaugggaguagcaaagggcuccucuggcgauuucgcugggcugaauuacauucccguugacgugauaagcgaugagaucuauaacccugucgugaggcguucagugcggauuaguuuuaaaaucuuaaacgccguccugaagaaauacaagguucuagacaccauugugaucgaaaugccacgagauagaaauuccgacgaggagaggaagcgcauaacugauagccagaaacucaacgaaaaggagauggaguucaucgagggaaaacuggcucagauuuauaauaucaaacuuucuucaagugacuuuagcucccagaagcaauugucucugaagcucaaacuguggaacgaacaggaugguauuugucuuuacucgggccggacaaucgaccccgaggauauaauuaagaauccugaccuguucgagaucgaucauauuaucccaagaagcauauccuuugacgacucaaggaguaacaagguauugguguaucgcucugaaaaucagaaaaaggggaaccagaccccguacuucuacaucacgcacagcgauggagccuggaccuaugagcaauuuaaagcaaaugucaugaaccucuccaagaaaaaggaauacgccauuucacgaaagaaagugcagaaucuguuauauagcgaggacaucacaaagcgggauguucugaaaggcuucauuaaccguaauaucaacgacacugguuacgcuucuagagugguccuaaauaccgugcagaacuuuuucaaggcgaaagaagcagauacaaagguaaagguuauaaaaggguccuauacucaccagaugaggaguaacaugaagcucgacaaaaaucgcgaugagagcuacucucaucacgccguggacgcuaugcugaugggcuuuuccgagaugggauaugaagccuaccggagacuucaaggcgaguucauugauuuugaaaccggggagaucuugaagaacgacauguggaaugagaaaaugucagaugacgucuacguggauuaucuguacggaaggaaguggagugcaauccgaaacgaaauugucaaggccgagaaagacgugaaguucuggcauuucaucguucgcaaaagcaaucagggucucugcaaccagacaauucggggcaccagagaauaugacgggaagaaauacaagauaaauaaauuugauaucaggacuaaggagggagugaagcuguucaaaaaguuagcuuuuucggaaaaagaguccgaccgugagaagcugcuuguauauuugaacgaucgccagacguucaauaaccucgucaaaauuuuugaagacuacaaggaugcccccaauccuuucgugcaauaugagaaggaaacaggcgacguugugcggaaauacucuaagagacacaacgguccaaggaucgauaaacugaaguacaaagacggggaggucggcgcauguauugauaucagccacaaguauggacuagaaaaggacucacgaaaagugauacuggagagucucguacccuaccggauggauguguauuacaaggaguccgacaaaauguauuaccugguuggcgucaagcagucugacaucaaaagccagaauggggcgaacgugauugaugaagaccuuuauacccgcaucuugauuaaugagaagaugaucgaaccuggacaauccagagaugaccuggagcaguuagguuacgaauuuagguucucauuuuacaagaacgauauaauugaguaugagaaagaaggcaagguguucgucgagcgguuuguuagccgaacuaugccaaaagugagaaacuacaucgaaaccaagcccaucaauaaagcuaacuucgagaagcagaauccgguggggcucggaaagacaaaaaguauuaagaaauaucgcaccgacauacugggcaacagguaccuuugcgagaaggaaaaauuuacuaaguucuguuga

SEQ ID NO: 2756 - RNA, 3315 nt, Artificial Sequence
  Cas9 variant
augaaccacuacgugcugggccucgacaucgggauuaccagcgucggauaugguguuauagaucuugacaauuaccaguucguggauuauggcguaagacuguuuaaggaggggacagccgaagacaacgugaauaggcggacuaaacgcggaucccgacguuugaagagaaggcggcaaacgcgcuuagaugacaugaaagagcugcuacagaaggagaaaaucaugucugaaaccuaccauucaaguuaugaucccuacgacaugagaauuaagggccucagccagaagcuguccaacgaugaacuuacaugcgcuauccugcacauuacuaaauguagggguaccacauuggaggcacucgacucugccgaugaggacucggaagggaccaagucaauccugagcaaaaaugaucaggaccugaagaaauaucauuacgucugccucgugcaaaaggagcgguuaaagcagaguggaaaaauacgcggcacugaaaacaauuucaagacagacgauuacaucaaagagcuggacgagauucuuucccaccaggauuugucugaagaccugugugagaagauccgaaccauuguuagcagaaggcggcaguauuacgaaggcccuggguccgagaaaucaccaacgccguauggacguuggaucgcgcaagguguggcucccauagaucuaauugaaaagaugcgcggcaaaugcagugucuuuccugaccagcucagagccgcaaagaacagcuacacugccgagcuguucaaucuucugaacgauuugaauaaccucgagugugaaggggagaagcugaccacaucucagaaacaggacgugaucgauuuuguaaaugaaaagggaggcauuacuccaaaacaauuagcuaagcugcucaacguugaccuuaaucagaucaaagguuucaggaucgauaagaacgacaagccccuguugaccgaguuuaaaggguauaaggcauucaaaaagauuuuugacacaaacaauugcgaucuauacaaaaaggaccuguccauacucgauggacuggccgaaaucgugaccggcaagaaaggcauugaggagcggaagcaggcuauccaacaggccuauccugaaauagacgaggcgauugucgaacagugugcagugaugaaagggaugacgcaguaccauucacuuagccugaaggccaugcacuugaucaaccaagagaugcuccagaguccacgaaaucagaugcaagugcugcacgaaucucaugucuucgauaaaaaccgcguuucccacaagggacagaaguacaucgaggcugacgaugaggccauuuuaagccccgugguaaaaagagcacagagggaaacuuuuaagguggucaaugcucugcgggagaaauauggugaguucgaaucgaucgugguugagacaacccgcgacagaaacucucaggaacagaagaaaaggcuaaaugauucccaaaaguacuaugagcaggaaaaccguaaaguggacgagcuccugucacaugaaggcuacgauccuaguaagauuaaugggaagacuaaacuuaagguccgguuguaucugcagcaggagggaaaaacagccuacaccaacgcgccaauagaccucaaucugcuuaucaaggaugccacggcauaugagguggaccacauuaucccgcugagcaucuccuuggacgauucuauuaacaauaaagcucucauaaaccgaaccgaaaaucaaaacaagagcaacaugacacccaucuacgccauucugagaggcaaguuaaauaucucacuggacacuuacaaaaccguaguuaagaacaauaggaacuauacagguaaaaagcgcaguuaccuacucuaugauaaagacauuacuaaguuuuccaauaugcaggaguucaucgcucggaaccugguggauaccagcuacgccugcagagucgugaugucuacacuuucagacuauuucaaggauaaugaaauaaguacccacguccauacugugagggggcgcguuacgaacauguuucgaaaucggaucaacaugcagaaagagcgugaaaaggacuacuugcaccaugcaguggaugcccugauuguagcuagcaucaaaaagcucaaucuguuaaacacauaucugcuuaaauacaauuucaacgacuuguacaaugaggagaccggcgaagucuuugcggugggagaugaccaacagguucucgauccuaaguauauuagauucaucacucagcugaagaccauauacgacgaguccaacauguauuacaacggccuaauugaaaggaaugugaugcaguuuccacccaucaaaauuucucacaagaucgacacaaaaccuaaccgccaaauaucggaugagaccaucuauagcacucggacagucgggaaugaagaguacgugguaaagaaauauuccgacauuuacgauccaaaguucacgcagcugaccgacgauaucauuaacgacagaccccucgauagguggcugauguaccgaaaugacaaccagacuuuuaaaaucauacagucaauuauccuugaucauuuccacaucuuuaaggacgaugagaagcacuauaguuguaccaaaaagaaaggacaaauucaguacgcauugaaggguaaaaauccgcuguauuuauacaagcaggaacauggcaaggugcgcaaauaugccaagaaagggaacggaccugagaucacaaugaugaaguacuucgacggcaaacucgguaauaacauugacauaucuaaucacuaucauguucacaacaagaaggucgugcugcuucagaucagccccuaccggacagauuuuuacguguccccagaagggaaauauaagaugcugacugucagauacgcuaauguuuucuauaaagagucaaagaaaaaguacgugauugacgagaagugguaugccagcgagaaaaagaggaaaaacaucaccgaugacgauauuuuugugugcucuuugcaccaugacgaacucaucggcauacaaaagaaagauggagcaaaguacguauaugaccuguccacggaagauggcgggaagccucgucuauaccacggagagauggaaauccugaaauucaccgccacaaauaacgacaguaagaacauuaucgaggucaaacccauuuacacuuauuguaagaaacagcucaugaucagcauagguccaauuaccaagcuggcuaaauacgccacagaugugcuuggcaauguuuaugaggugaagaagaacaucaucgaccauuugucucaccuguga

SEQ ID NO: 2757 - RNA, 3318 nt, Artificial Sequence
  Cas9 variant
augggcaucagaauugggcuggacauaggaaucgccagcguggguugggcugucguugaugacgauuacaacauuaucgaguccggcgcaaauauuuucaacgaagccaaggcggcuucuaauguggacaggcggaccuuucgccagacaaaacgacuccuucguagacaaaagacuaggcugcgggauuucgacaucuuguggauaaacgccggguuagauauccccaaagagaagguaaauaaacagcugcaguuucgcgugcagggaaugacgauggaacuaucagagaacgaacucuaugcagcccugaagaauaugcuuaagcacagaggcauuaguuaccuggaggacgcuuuggaugaggaacaaagcgguaaauccaccuaugagaaggggcuccaggucaaccagaaagcacugaagugcgacaaaaugccuugugaaauccaguacgagaggcugaugaaguauggaucuuaccggggccauauugaggugaaggaugaaucgggcgaggaaaugauccucucaaauauauucacauuagacgccuauugcaaagaggcuaagaaaauucuggaaugucaaaagcaguaccacagcuuuaucacugaggccuucgaggaugacuaccuugcguugcugcgccgaaaaagaaaguauuacgaagggccaggaaacgagcagaguaggaccgacuaugguaaauacacaaccaagcuaaauccggaaacuggcgaguauguuacagaagagaacauuuuugagaagcucaucgggaaaugcuccguguaccccaaggaaaugcgggcaucugccgcuagcuauaccgcccagaucuacaauaugcugaacgaucuuaauaaccugacgauuaacggacguaaauuggaguacgaagagaagaaauccauagucgaagaggugcaaaaggcaucaaguguaaauaugcucaagaucauuaaaaagguuaucaacgaggacauaacuaccauugaaggcgcucgcaaagauaagaaugacaaagagaucuuccauaagauggaaacauauaacaagaugagacacuacuuugagaaaaauggucuggaguucaagaaaaucagcacugaugacuuagaugaaauugggaacauccugacccucaauacagagaaggaagccauucuugaggcguuuaacaaaucucagcuggaauugucccaggaggagaaggaagccuucauagagaucaggaagaaaaauggaucacuauuuaacaaguggcauagcuucagucugaaaauuaugaaggaacucaucccugagcuguaucuucaaucuaaaaaucagaugcagcuguugaccgacaugggcguguucaagaaaaagacggaaaucuuucagaacuacgauaagauuccaacugacgucauaaucgaggauauuuauaaucccguggugaaacgguccauccgaauuacagucaagaucguuaacgcacucaucaaaaaguacggcuauccucgcgaggugguaauagaaaugccaagagacaggaauagcgacgaggagaaaaagcggauucaagaugaacagaagaaaaacgacaccgaacugaagaaaaucauugagaagguggagucggaauacgggaucaaaauaacugauacacacuuccgcaaccacaagaauuuaagaaugaagcugaggcuauggcaugagcaggacggacguugucucuacucugguaaagucauugauaucuccgaacugcuuaacgacugcucaaaguuugagauugaucacgugauccccaaaaguaucagcuucgacgauucccggucuaauaagguuuugguguauagcaccgagaaccagaaaaagacgaaucaaaccccuuaccaguaucuggaaggcaacgggaaggaguggucauuugacgaauacaugaaucaggucauagagcucaaagaucgaaagcugauuaguaaagcuaagaugaacaaacuucuguucagagaagacaucacaaagauugagguguugaaaggauuuaucgccaggaauauaaacgauacucgcuaugcuucccggguaguucucaauagcuuccagaaguacuuugagucuaagcaaucagacaccaaagugaaggucauuagaggcaguuucacacaucagaugaggaaaaagcugcaguuaagcaaaaaccgcgacgaauccuaugcccaccacgcaguggaugccaugcugaucuguuacucucagauggguuacgaggcuuaucgacaacuacaggaagaccucaucgauccagacucggagaagauucgggaucuggggcuuuggaaggaaacuaucaccgaggcgaaauacgacgaggucuuguauacagcaaaguggcuggaaaaucguggcaaaauucaggaggccgaaaagaaagugaaguuuuggcauaagguugauagcaaagcuaacagagcccucugcaaucaaaccauaaggggaacucgcgugaucgacggcuccauucagaagaucaacaaaauuaacaucuacucaguagauggguauaagacguucaaaaauaugauacagaagggaaaggagaaagacuuucugauguaccggaacgauagaaggaguugggacgauuuaaugaaggucuaucgagaauacucugacgccaaaaaugcauucgcugccuaccaggaggagacaggugacuaugugcgcaaguacgcgaaaaagcacaacggcagcaagaucaccaaucugaaauauugugcaaaggaacuuggguccugcauugauaucucacauaaauacggauuggagaaggacagccggaaaguuauucucgaaucucuguccccguauagaagugauguguacuauaacgcuggccuaaagcaauacuacaucgucgguauuaaaaauagcgaccuguguuuccucaagggggaguauuuuauagauucuaagagguaccugcagauccuucgugaggaaggcguguugacugagcagcacacccugaacgacuuagccgcaaucggaacagaguuccaguuuucccucuaugaaaaugauuaccuggaauaugagaaaaacggcgagauuaagaccgaacgcuuccuuucacggacuaaacccaagcagaaaaauuacauagagacaaagaguaucgacgccccuaagauuaaaaacaagaaacaaaaucugguaggguuggcuaagagcaaaucgaucaagaagauuagaguggauauccucggaaacagguauuacgccuccaaagaaaaguuuucucugaugguugacaaauucuga

SEQ ID NO: 2758 - RNA, 3318 nt, Artificial Sequence
  Cas9 variant
auggacauggccuggagacugggccucgaucuugggaccaacagccugggaugggcugcauuguccuuagacgccgcgggugcucccgaugccauccuggcagccggcucuaggauuuucggggacggacgggauccucagucaggcacaagucuagcuguggaccgccgagcagcccgugcugccagaaggcggcgcgauagauuuaagcaaaggcagcgggcgcuccugaaacaccuugaggcagacggucuguucccagccgauccggaaguccagcaggcuuuggccgcacucgaccccuacgcucugcgcgcccgagcgcuggaugaggcccucagcuuacaugaaauagggagagcacuguuucaccuuaaucaaaggcggggauuccaguccaaccguaaggcugaccgcggcaaagaugaggacgccggcaagaucgcuauugggguugacagauugaaagaugccaucgcagccgcuggagcgaggacuuuuggugaguuccugcggcagcgacgcgcaggcgccacgggggagaaucagauuccuucugugagaaccaggcuacgggcugagacaggagaaggcgccaaggguucgggguaugacuuuuacccaucacgcgcacuccugaaggaugaguucgacgccaucuggcaugcucaagccgaacaccaucccaaaguacuuacugaugaggcauaucacagacugcacgagauaguguuuaggcagcguccuuugcgggcgccaaaggucggagcuugcacccucgugcccggcgaagcccgacugccuaaagcacauccauuauuccagagaaggcgccugcucgaggaacuuaacgcccugaugaucguucgggcuggcgccguggcagagagauugacaccggaacagagggaccuacugcuccugaaacuuaaagauaaggggaaggucaccuuuaaaagccugcgcgagaagguguugaaacucgacggagaugcucgauucaauaaggagagugaacaccggacugagcugaaaggugacgaaguagccgcggagaugggcgggaagacacguuuuggauccuuauggccccaucugucuaccgaacaacaguggacgguuauugagagacagcaagcccuagagagcgaugcugacgaagcagccuucaggacuuggcucguggagacccacaaacugacagcugaacaggcccgcgcagucgcgggcgcccggcuuccugcuggucacgggagauucggcuugacugccaccgcagcucugcucgccgcacugagggacggacgaacaccagagggccgcgggcccaacgccccugcuaccgaagcgggacgggugguggucuacuccgaggccgcagcuaucgccgguuaucaucacucagaucauagaaguggcgagguuuuuacggacgccaaggggaggccagcccuucccuacuauggagugccgcuggaucgucacauuguaccuggcacugcagaccccgaugaaccagacgaggccgcgcgcaucggucgguugacaaauccuaccgugcauauagcucucaaccagcugagaagggucgugaaucgauuaauucggguuuacgggcccccagccgaaguggcacuggagcuagcccgcgagcucaagcugagcgaagaugagaaaaaggaaagaaacagggaaaauucucggaaccgacuugacgcugaaaagagauccucaaaguuggcagagcugggccagcgcgauaauggaggcaacagggcccuccugaaauuaugggaggaacugaaucccgagaacauccuugaccgucgguguauuuacagcgggagacaaaucaguaucggaaugauuuucucuggugcggcugaagucgaucacauauugccuuuugacgccacucucgaugacuccaacgcaaauaagauccugugccuaagggaggccaaccgcgacaagcgaaaaagaagcccauucgaggcuuggggcgggacaccgcagugggaagagauugccgaacgggcaucgaggcugccccgcaauaagcguuggagauuugagccugaugcuauggaacgguucgccgaggaaggaggcuuucucgcgaggcaccugguggacacccaguaucuuggucgcaucgcccaugauuacuugcgaugucuguauccagacaaaggggauggaucuucccacguauggguuucacccggcagauuaacggagauggugcggaggaagcucggccugaacgggcuucugggagaccauaauuugggcgcagagcagccuaaaaaccgcaaggaucacagacaccaugcuauagacgccgucgugaccgcuauucucgauaggaguaugcugcaacggauccagcgugcaagcggugaaggggccuccgacgccgagcuacugcgcaucauugucccagaacccuggacaggauuccgagaugaccuccagagagcuguggauaggaucguuguggcgcaccgggcagaccauggcacuguagccaaggcugccacccgcgguagagaccagacagcagccaggcugcacaaugauacugcuuacggcuuuaccggggaggcggacgccaaaggaacaccgauugucgugcaucgggcaccucuuggcgcuuugaagaaaccagagcacauagaucaaguucgagacccccuguuaagagccgcacuccacgauuucaccgccgggcugucuggaaagccuuuugaagaccgcaucgcugccuuccccaggcuuggcccacuggauuaucgggguauucguagagugagggucguggagccucuacagguaauccccauccgcgacgcggcagggcgggccuacaaaggauauaagggcgauagcaacuaccgauacgacgugugggaacucccagaugguaagugggagcagagaguucugcagauguauuacgcucaucaaucaggcgaaccgccuaggccccacccagccgcucgcaaagucuugagucugcaucgggacgacguguuagcaauugagagaggggagggaggccgugaacucgugagggucguuaaguuuuccacuaaugaguucacgcuggcuccccuuaacgaagggggagcucugaaaagccggcacgccgauaagggcgacccuuuccgcuauuuguacccaucucccucaacacucaaagcauggcgagcgagagaggugaggguggaugaacugggucggguacuagacccuggguuuccggcccgcaagagaaggcgagucacccggccaggacgugcugaugccgacuga

SEQ ID NO: 2759 - RNA, 3321 nt, Artificial Sequence
  Cas9 variant
augcaguacaucguggccauugacauaggcgucgcuagcguuggguaugcagugaucgauaagaccuccgagacaguaauugaagccggaucuaacaucuuccccgaggcgucagcuacugacaaucaagaaagaagggguaugcggcaggcccgccgacugaaacguagagagaggacgcggcucgaugacuuuaccaaacuuugggaauaccacggccuggcaauuccucaggugaaaaagaacgauaucgucggguugaaagugaaggccuuauaugagaguauaagccuggacgagguuuaccuaauccucuauuccuaccugaagcaucgcggaauuucuuaucuugaagauguggaggacucgucagucagcggcaguacagcuuacgcaaauggucugaaauugaacgccaaggaacucgagaaaaauuucccaugcgagauccagaaguacagacuggaaaacauugggaaauauaggggacaaauccagauagaggaugaccagggcgaaaagcuggaucucuccaauguguuuacuauuggcgcuuacaccaaggagauccagcaaauuuuagacacacagaaaaaguaucacgccgaaaucgaggaugaguucugugaaaaauaccugaagaucuuuacccggaaacgcaaguauuacgaggggccgggaaacgaaaaaucucgaacugacuaugguaaguacacaaccagacuuaaggagaauggcgaauacauuacggagaaaaacauauucgagaaguugaucgggaaaugcagcguauauaaggacgaacugagggcggcauccgccucauacacugcucaggaguuuaaucuacucaacgaucugaauaaccuuaccguuaauggacggaaacuggaagagaacgaaaagcauuugauuguggacaaggucaaaacaaguaacacuaucaauaugcguaagauaauugccgaugcaaugggcgagaaaaucgaggaguucuauggugcucgcaucgacaagagcgaaaaagaaauuuuucacaaguucgagguguacaacaagaugagaaaagcccucgcggccauccaugugaauauugaggaauuuucuagggaugaccuggaugagauaggguauaucuuaaccauuaacacagacaaggaagcaaugauggaggcuuucgauaauucccggcuggaacuccccggagagaucaaaaacugucuuaucucacugcgaaagaccaauggcacguuguacagcaaauggcacaguuuuucucuaaagauuaugaacgagcugauaccugaaauguaucgccagccaaaggagcaaaugacucuccugacagaaaugggcgucaugaaagggcagaccgacgaguucgaaaagaauaaauacauccccguugauguggccuccgaggacauuuucaacccuguagugagaaggagcguccggaucucguuuaagauucuuaaugcucugaugaaaaaguacggaacuuuggacgaggugguuaucgaaaugccacgcgauagaaacucugacgagcagaaaaagugggaaaaggagacacaaaagaagaaugaaaaagagcaggaguauauagaaaacaagcucgccaccguguacgauaucaggcuguccucagcagacuucaguagccagaaacaguuaaaucugaagcuaaagcucuggaacgagcaagaugguaaaugccuguauuccggcaagauuaucgaacccgaggaccuuauuaaacacucugaguuguuugaaaucgaucauauaauuccucguagcaucucauucgacgauagucgguccaacaagguccugguguaccgaacggagaaucagaacaaagggaaucagaccccauauuacuaucucacacacacuaacagcaaguggucuuuugaacaguacaaggcccugguaauggaccuuaguaaaaagaaagaguacggacugucaaagaaaaagguuagaaauuugcucuauagcgaagauauuaccaaggcugacgugcugaggggcuucaucaaccgcaauauaaacgauacauccuacgcggcacgggucguguuaaauacuguccaagguuauuuuagagccaaagagauggggaccaaggugaaaguuaucaggggcucuuacacacaucagaugcgcgugaacaugaagcuggacaaagaccgagagaagucguaugcucaccacgccguagaugcaaugcuaauugccuucagccagcucggauacgaggcuuaucggaaacugcagggcgaauuuaucgacuucgaaaccggggagauucuuaauuccgaaaaguggaaggaucaaaugucagacgaggucuacaaacaguacuuguaucguaagaaauggaguaacaucagaaaugagauaacuagggccgaaaagaacgugaaauacugguauuacguugaucauaagucuaaucgcggacuguguaaccagaagauucgggguacgagaguguaugacggcaaaaucuacaagaucaacaaacucgauauuaggaagaaagagggggcagcgcuguuuaagaaguuagcuuucagcgaaaaagaguccgaccgagaaaagcugcuugucuauaaaaaugauaagaaaacauacgaggacuuggugcgcaucaugcaggauuacucagacagcaagaacccguuuguacaauaugagaaggaaaccggagauuacgugcggaaauaugccaagaaacacaauggccccagaauugacaagcucaaauacauagacggugagguugggucuugcaucgauauuucccauaaguauggcuacgaaaagggaaguaggaaagucgugcuggagagccuagugccuuaucguauggacgucuacuacaagaaagaggaacagacuuauuaccugguuggcaucaagcagucugaugugaaaugucaaaagggggaguaugugauugacgaagaugcauacgccaucaaccucguaaaagagaagaugauacagcagggacagaagcgcuccgaccuggaaucacuugguuucgaguuccaauugaguuuuuauaaaaaugauaucauugaguacgaaaaggacggcaaaaucguccgggagagauuccugagcaggaccaugccaaaggugaaaaacuauauugaaacaaagcccaucgaucgagcuaaguacgaguggcacgaccggaaauuaguugggcucggaaagaccaaacgcauaagaaaguacaggauggauauucugggcaauuauuaccuuugcaacaaagaagaguuuucgaaguauuguuga

SEQ ID NO: 2760 - RNA, 3324 nt, Artificial Sequence
  Cas9 variant
augggcuacaccguggggcuggacaucggagucgccagcguugguguggcuguacucgaugagaacgacaauauuguggaagcagucuccaacauauucgaugaggccgacacaucuaauaacaaggugagaaggacucuucgggaaggccgccgaacgaaacguagacagaagaccaggaucgaggauuuuaaacaacugugggaaacaucaggguauauuaucccccacaaguugcauuuaaauauuaucgagcugcggaacaaaggacuaacugagcuccugagucuugacgaacuguacugcguuuugcucagcaugcugaagcaccgcggcauauccuaucuggaggaugcggacgauggugaaaaggggaaugcuuacaaaaagggacucgccuucaacgagaaacaguuaaaggagaaaaugccuugugaaauccagcuggagagaaugaagaaguauggcaaauaccauggcgaauuuauuaucgagauuaaugacgaaaaggaguaucagucuaacguguucaccacaaaagcauacaagaaagagcuugaaaagaucuuugagacccaaaggugcaaugggaacaaaauaaauacuaaguucauuaagaaauacauggaaaucuaugagcggaagcgcgaauacuauauuggaccagguaacgagaaaucgcgaacagauuacggcaucuauaccacgagaacugacgaggaagggaauuuuaucgaugagaagaacauuuucggaaaauugauaggcaaguguucagucuacccggaagaguauagggccagcagugcuuccuacaccgcacaggaauuuaaccugcuaaaugaccucaacaaucugaagaucaacaaugagaaacuuacagaguuccagaagaaagaaauuguggagaucauaaaggacgccucuagcguaaacaugcggaaaauuaucaagaagguuaucgaugaagacauugagcaguacuccggugcucguaucgauaaaaaggggaaagagauuuaucacacuuuugaaauauaccgcaagcugaaaaaggaguugaagaccaucaauguggacauugauucauucacaagagaagaacucgacaaaaccauggauauccugacguuaaacacugaaagggagaguaucgucaaggccuuugacgagcaaaaauucguguaugaagagaaucugauuaagaaacucauagaguuccggaagaacaaucagcgacuuuuuagcggauggcauucuuucuccuacaaagcgaugcugcaguugauccccgugauguauaaggagccuaaggaacagaugcaacuacugacagagaugaacgucuuuaaaucaaagaaagagaaguacguuaauuauaaauacauuccagaaaacgaggugguaaaggaaaucuacaaucccguggucguuaagagcauucgcaccacugugaaaauccucaacgcacugauaaagaaauauggcuacccugagaguguggucaucgaaaugccaagagauaagaacucugacgaugagaaagagaagauugacaugaaucagaagaaaaaccaggaagaguaugaaaagauccuuaauaaaauuuacgacgagaagggcaucgagauaacaaacaaagauuauaagaagcagaaaaagcugguguugaaacucaagcuguggaaugaacaagagggguuaugccuguacuccgguaaaaagauugccaucgaagaccuacucaaccaccccgaguucuuugaaauugaucacaucauaccuaaaagcaucucgcuggacgauucuagguccaauaagguacuuguuuauaagaccgagaacucaauuaaagagaaugacacgccauaccauuacuugacccggaucaacggaaaguggggcuucgaugaauauaaagcuaaugugcuggagcuccgcagaagggggaagauugacgauaaaaaggucaacaaucugcuuuguauggaagacaucacaaagauagauguggucaaaggauuuauuaaccguaaucugaacgacacucgguacgccagucgagugguuuugaacgagaugcagagcuucuuugaauccagaaaguauugcaauaccaaagugaagguaaucaggggcucucucacauaccagaugcgccaagaucugcaccugaaaaagaaccgggaggagagcuauucacaucacgcagucgacgcuaugcugaucgccuucagucagaaggguuacgaagcguauagaaaaauucagaaggacuguuacgauuuugagacuggggaaauccuagacaaagagaaguggaauaaauacauugaugacgaugaguucgacgauauacucuauaaggaaaggaugaacgagauccgcaagaaaauuaucgaagccgaggaaaaggugaaauacaauuauaagauugacaaaaagugcaaccgaggccuguguaaucagaccaucuacggaacacgggagaaggauggcaaaauacacaagaucuccagcuauaacauuuacgacgauaaagagugcaauucucuuaagaaaaugaucaacucagggaagggaagugacuugcugauguauaauaacgauccgaaaaccuaccgugacaugcucaagauucuggaaacuuacagcuccgagaagaaucccuuuguugcauauaacaaagaaacgggugacuacuucagaaaguauucuaaaaaucauaacggcccuaagguggagaaagucaaguacuauucggggcaaaucaacagcuguauagauauuucccacaaguacggacaugcuaaaaauucaaagaaagugguauuagugagucugaacccauauaggacagacguuuacuacgauaaugacaccggcaaguauuaccuugucggugugaaauauaaccacaucaagugcguggggaauaaguacgucaucgauucugaaacuuauaacgaguugcuccgcaaagagggcguucugaauagcgacgaaaaccuagaggauuuaaauuccaagaacauuaccuacaaauucucacucuauaagaaugacauaauccaguacgaaaaaggaggcgaguacuauacagaacgguuucugagcagaauuaaggagcagaagaaccuuaucgagaccaaacccauuaauaagccuaacuuccagaggaaaaauaagaaaggggaaugggagaacacucgaaaucaaaucgccuuggcuaagacaaaauacgugggaaagcuggugacggauguauuagguaacugcuauauagucaacauggaaaaguuuucucucgugguugacaaauga

SEQ ID NO: 2761 - RNA, 3324 nt, Artificial Sequence
  Cas9 variant
augggcuacacccuggggcucgacaucggaauugccagcguggguuucggccuuauagauaacgucgacgggaagauccuggaguccggaguuagauuguuuucuucagcugaucccgacaauaaccagacaaggcggaguagccgccaagcacgacguuuaaauagaaggaaagugcaccggcuggaacgcguagcccaucuacucgaggaagcgggcuucgagaagggugaagugcuggcuccuacuccauaucaccuuagagucaaagggcugacggagaaguuguccaaaccggagguguacgccgcacucuauaaccugaugaagcauaggggaauuucuuaccuggaagauguugagcucgacgaagccgauucgucaagcgugagucagaaugucgaguuacugaaggaguauuaccccugcgaaauccagcuugagcgguaugaagaguacggccagauucgcggcaucauagaaaccuacaacaaagacggggagaaggaguccuuggugaauaucuuuccuacaggagcuuauaaaaaggaagcagaggccauuauccugaaacaaggucaguucuacccagaacuagauaagguauuucucgagaaguucacugaaauucugaccguuaaacgacccuauuacgugggcccugggaacaagaaaucuagaacagacuauggaaucuacagggagaauggcgagacccuugaaaaccuguuugauauauugauugguaaguguacuaucuauccacaggaggcucgggccgcgaaauucagcuacacagcacagcucuuugacuuccugaaugauaugaacaauauuuccaucgccggggaaaaguuaaccgagguccaaaaacgugaaaucuaccaccagauuaugucaaguaagacggugaacaugaugaagauaaucacuaaagugaccggaugccugaaggaggaggucacaggcuaucgcguugacagcaaauacaaggcugaauuucauucuuucgccuccuauagacaguuuaggaauaaaaugcucgacuacggcuucgaugugcagacucuuaacguagagauguucgacaagcuggcagcuaaguugacccuaaacacagaauaucaccaaauuaucacccagcuggagucacucaaucuggggcuuagcaaagagcugauagaaaagauugccgauuuucggaaaaagaaccgaaguuuguucucuaaauggcacucccucagccugaaggcgaugaaugagguggucgacgaauuauggucgacgucuaagaaccagaugcaaaucuuuuccgagcugggagguuucaaaucaaauaucgaaguguuuaagggccuaaaauacauuccccucgaugccaugguugacgagaucuauaacccugugguccgcuguaguauuagagagagcauaaagaucauuaaugcacugcuuaaaaaguacggggcuuuggauaaggugguaaucgaaaugccaagggacuccaacgagaaagaagagaaggaucggaucacuaaacugaauaaggaaaacgacaauaaaaagaaacaggccauugagaaggcucgcaacgaguacggauucggcgaagaggccuauagacagcagaaugaucucaacacaaagcugaggcuuugguacgaacaaaaacagcguugccuguauucuggugagauaaucaagauuuuugacuugaucaaaaauccgcaucucuucgacauugaucacaucauacccaagagcaucucauacgacgauagucuguccaacaaaguuuuauguuaugcaaccgaaaaccgggagaaggggaaucugacuccuuaccgauauuuuaagagaaaagccagccuaacauggaacuacgaggcuuacaagucuuaugugauugaacucuacaaagacggcaagggagaucugucaaggaccaaacuugaguugcuccuguucgaagaggacaucaauaaguaugagguccgccagcgguuuauuaacagaaaucugguggauacgagguacgcgaguaaggucguguuaaacacccugcaggacuucaugaaagaaaauuauccaacaacuaccguugaggugguacgcggcaaguuuacagcacaacuucgacggcauugggggauccguaaaaacagagaugaaaaucacgcccaccaugcuauagacgccuugauuaucgcaugcgucccccaccucagccuguggaaggagcagaaaaagguguucuccacugaugaguucaggguugacgaaaccacaggagagauuaucgaacagucuuacaaccagcuaaccuaucaagagccuuuuucgcaguucuuuuaccagcuggaaaaggugagcauagauugucgcuacuccuauaaagucgaccggaaguucaauagacagguggccgacgcuacuaucuacucaacgaggcaagguauuguaaaacagacaaguggcgauaagucuuuuacccucgacagcaacuccaaagagcauuaugugaucgccaagauuaaaaauaucuacgaagauguugacgcaaagcgauucauggaucgcuauaagaaagacaagacucaguuucugauguaccaccaugauccacaaaccuucucaauacuugaggacgucaugaaaacauaucccgauaagaaaaacccguuucaggcguaccgguuggaguacgggccuauuagaaaguauagcaagaaaggaaauggcccccagauccagucuaucaaguacuaugacuccaaacugggucaacacauugaauuaaagcaggcuaaccagaguaccaaaaagguggugcuccagagccugaacccauggaggugcgauaucuacuauaauaagaaagacaagcguuacauugccgcagggcuuaaauaugccgaucugucuuaccaaaagggcacuggauuguacggcauaucccuccagcgcuaucagcagauccugaacucagagaaaauugaacuaaguaucgagcaaauugaacugcuccuggaggggcggcuuaaugagagcaacuucgaauuuuguuucucguuguacaagaaugacuuuauccaguggaacgacgagaauaaccagacauuccaauauagauuccuggcuaggaauuuauccucuccuaaccgaauagaagucaagcccaucaauaaaagcaaguacgauaaacaggccgagggacucaagacgcugaaaaagggucuuaaccgguuuuauaagauuucaguugacgugcugggcuaccagcacuucaucaaaaaggagaaacuaaagcucaccuuuaaauga

SEQ ID NO: 2762 - RNA, 3330 nt, Artificial Sequence
  Cas9 variant
augagccacuacgugcugggccucgacaucgggauuaccuccgucggauaugguauaaucgaucuugacacaaacgauuucauugacuacggcguuagacuguuuaaggaagggacugccgcuaauaacgaagauaggagaaauucucgcucacgacguagauuguuaaguaggaaacauacgcggcugauggacaugcagaaggugcuaaaagaggcaggaaucaugaccgaaagcuauucuccccucuccaacguauacgagauucgcaagaaaggccugacaaaggaacuuacuaaugaugagcugaccgccgcgaucuugcacauaacaaagcauagagguucggugaucgagaccgucgaagacgaugaggcugccgcaaaagaaacuggggagcucaagucaacacugcacgagaacgcccugcucuuagcuaauaacaaauucgugugcgaaauucaacuggagaggcuuaauaccgaaaacaagauccggaaucauaaaaacaauuuuaagacgaaggacuauguugcagaguugaaagaaauucugaaccaccagaaucuaagcgaggaggugaagaacaaaaucauacagauugucgaacgcagacgagccuacuaugagggaccuggcaguuucaacuccccaacuccguacggcagguuuaucgaagugaaugggcagguacaagagauugaucucaucgaaaagaugcggggaaaauguucuguuuaccccgacgaguuccgugcuccuaagaugagcaucuccgccgaucuguuuaacauucuuaaugacuucaacaaucuguuggugcagggugagaaacuccaggaagaggacaagaagaaccuguuaaaaauaaucaaugauaagggcucaauuacccugcgccagaucaguaaaaagcucgaagucaacgaggacgaaauaaaaggguauagaauugauaagaagggaaaagcgcuuuuuacagaguucaagggcuacaaaauccugaagaaauuguuucuaaauugcggucaaagcaucucucuggaggacuaugaaaugcucgaugagauuaucgaaauugugacuaagaagaaagggauagacgagaggaaggaugcacugaaagagcuuaagugggaccuguccgaugacaucauuaacucauugagcgaagugaccggaaucgucggcuaccacagucucucucugaaagccauccgggaguuagauuccgaacuguauaagacaagccuaaaucagaugcagcuccugcaugagcuuaagauguucgacaaaaaccgaccaucguacaagggcaaaaagaauauuguugcugaccccgaagccauauugucuccuguggcaaaacgcgcucagaacgagaccuuuaagguaaucaaugcccugcggaaaaaguauggggaguucgauuccauuguggucgaaaugacgagggacaagaacucacaagagcagaaaaagcggaucaacgauagucagaaagcgcucgaaagccugaauaaggagguggaccaacuucugcagcagaaaggauacgauccacagaagguuaaggguaaaacuaagcaaaaagugcgcuuguacaugaugcaggaaggcaaguccgccuauacacuccaggagcuggacuuacacagagucauuaaagaugacaaguacaccgagaucgaucauauaauccccauuucuaucagccuggacgauucacagaguaacaaggugcuagcacuccacuccgaaaaucaacagaaagggaaccugacuccuuucauggcuuuucacacaggaagguucgccgacaugggcuguaccuggaauaaguuuaaagagaacguacuuagcaauaagaacuauaaacauaagaagaaaaauaacuugcuggaugaacgugacauuaauaaguucucuguuauccaggaguuuauaaaccggaaucucguggacacgucauacgcuaaccgagucgugcugaauaccuuaacagauuauuucaaagacaacgaaauugauacuaagguccacaccgugaacgguaaacugacagaccuuuuuagaaagaggaucaauuugaaaaaggaucgcaacgaggacuaccuccaucacgccauugaugcacugaucguugccaguauaaagaaacuacggcugcucgacggguaucuggcuaaguacggcuucgagacucuuuacgaugaaaugaccggagagaucaaagaaauuccagaggacaaggcguuuuucgaugacaaauauaucagauacauuuugaaucugaagacaaucuaugagagcuccaacauguacuauaggggcauauuagaacgcgaggaacucauuuaccagccgaucaagaucucucauaaaauugauaccaagcccaaucgaaaagugucggacgagacuaucuauagcacgcggauuauagacaacgaagaucaccugaucgagaaguacuccgacauuuacgauccuaaauuuaagaaucuuacagaggacauccugaacggggaaaagaauaaauauuugauggagaagaacgauccacaaaccuucaauauucucaaacagaucauauuuaaccacuacaauacuuauaaggacucaaaagaauacuauaagaucgagaagaaaaaggaaaaagagauuaucaagcugguaggaauuaacccccuaagucuguacaaagaggaaaaugguccuaucaagaaguauucuaaaaagggcaacgggccagucauaaugagcaugaaauacgauuccgagaagcucggaaaccauauugacaucacccccgauucagccaaaaauaagaaagugauccugaagcagauuagcccguaccguacagacuucuauaagugcucugaugaaaaauucagauuuguuaccgugagguacaaggacguccacuaucagaaauccauagacaaguacuguaucgauaaagagugguaucaaaacgaaaagaagaauaaaaagauugacgagaaagcagaguuccuuuuuaguaugcaucacgaugaauugaucggcauuacucgcaaggagagcgaacaguucaucuacgacgagucuaaagagaaccacggugauccucgguaucaugacggggugaagcccgaaauacugaaguuuacagcuacgaauaacgauaccaaaggcaucauugagguaaagccauuauacacuuacuccgccuauagacucaaaccuacagugcugaauguuaagaacaucaaaaaguacgcaaccgacguccuuggaaaucuguaugaagugaagcagaacgagcuaaaacucgaguucuga

SEQ ID NO: 2763 - RNA, 3333 nt, Artificial Sequence
  Cas9 variant
auggccgagggcaagaaaagaaucuggaggcugggggcugaccucggagcaaacagccuugguugggccgcgauugaacuguccgcucccgugaauggcaagccuauagccaucuuggcagccgggucucggauuuucucagauggacgcgacccaaaaaguggcgcuagcuuagcagucgaucgacgugacgccagagcuaugaggcggcgcagagauagguuuaagcagcggcaaaaagcccugaucaaguaccuaauugcggacggucucuucccggcagaugaggccgcucgcaacgccauggcagcuaucgaccccuaugccguucgagcgagagcccuggaugaagcacuuucccugccugaguuggggagggcucucuuucaccugaaucagcggcguggauucaagucuaaccgcaaagccgacagaaaggcugaugacgaugccggcaaaauagcaaucggcauugacaggacccgggacgccaucgcugaagaugaggcggacgcaggggccgagccaggaucguggacauuugguaaguggcugcaugaacgacgccucaaaggccagucagugagaacuagguuacggcccgagagcggggaagaugcuaagggagacggcuacgauuucuauccugaccgcgcccugauggaggaggaauuugaugcaauuugggccgcucaggccccacaccaucccgacguacuuacgaaugaugugcacgacagauugcaugagaucauauucuaccaaaggccucugaaggcaccacaggucgguaugugcagucuaauuccgggggaucgucggcuccccaaagcgcacccucuguuucagcgaagaaggcuucuggaagaguugaacgcucucaugaucgugcgcccaggagaaguugcccagcggcugaccagagaggagagggacauuuuacugcucaaacuuaaagacaagaauaaaguguccuucgcaacacugcgcaaggccuugaaacuagaucccgacgcucgauuuaacaaggaaucugaggaucggacugaccugaagggcgaugaagucgccgcagugaugggcagcaaaacccguuucgggaaucucuggguacaccuguccaucgaggcucaaugggacguucuugccagacuggaugcgguggaaucagacgccgaggaugcugcauuuugugccugguuggucgagacauaugcucucaccccugaacaggccagggcaguggcgaacgccccacugcccccgggauacggucgcuucggcgagacugcuacacggaaguuaaucgaagcccugagagacgggaaaaaggaugacagggugcuagucuauagugaggcaguuaccgaagcuggacucggccaucacagcgaucgacgcacgggugagguguucgaggacgccaaagggcggccucagcugcccuacuacggcguagcacuugaaagacauauuaugccaggaacuggcgacccuucugaucccgaggaaaugaggguggggcguuugaccaauccaacaguccacauaggacugaaccagcuccgccggauccugaaugugcuuauuagagccuauggucccccugcugagaucgcgauagagcuggccagggaauugaagcucacugacgaggauaagaaacgaauuaaccgggaaaauaacgacaaccgcaucgcagcugagagaagguccgaaaagcuguuagccaucggccaagccgauucaggggcuaaucgggcacugcuaaaacucugggaggagcugaacccagccaauguucuugaccgaagaugcauuuacagcggacgccagaucaguauugauauguuguuuucugcggcuguggaagucgaccacauacugccguucgccgcaacccucgaugacuccaacggcaauaagaucgugugucugagggaggccaaccgugaaaaacggaagagaagcccccaugaugcuuggggucacucggcaaggugggacgagauugccgcgcgcgcugcccaguuaccucgaaauaagagauggcgguuugaaccagaugcaauggacaaauucagggacgaagggggcuuucaagcccgccaucugguagauacacaguaucuugcucguuugucuagagaguaccucgccacccuguaucccgagaagggagagggcuccgggcacaucuggguuucaccuggacggcuaacggaaauggugaggcgcaaacugggucucaacgaccugcuuccagaucauaauuucggcgggggagcagaccaggcuaagaaccgauuggaucacagacaccaugccaucgacgcggucguggucgccauuguggaucggggcaugcugaaugcaauagcuagggccaguggucaggagggggcugaaggccgcgagagaaucauuauccccgagccgugggacggauuuagggaugcauuacgggaaacuguuaaccguauuacagugagccaccgcaccgaccauggcacugccuccaaagccgggcucccuaagggaaaggaugcuacagcgggccgacugcacaaugacaccgcauacgguuucacgggggacaccgaugccaaaggaaacucuaucguagucagaagggugccacuuagcucauuuaagaaacuggcugacuuggaucggauacgcgacgccgaucucaaggcagcccuguaucaacaccuaaauggccuggaggguaaggcuuucgaaaaggcgcucgccgaguuucauaaacuggaguggcacaacuucggcgggguuagaagggugcgggucacagaaccccuuacugugaucccuauuaaggaccgaaacggaagaaucuacaagggcuacaaaggggauaguaauuaucgcuacgacguaugggaguugcccgauggaaagugggugaccaacuggaaaaaugaagcaggcgaggcuauguccagcguuauuucuauguuugacgcccaucagucaagugaaccaccuaggccccacccagcagcccggaagauccugagcuuacaucagaacgaucuccuggcuauagagcgugagggugaagacagaaaacuuaugagggucgugaaguucgggcaguccggacaaauuacacuggccgagcaccagcaggcgggcgaucuaaagaaacgcgacgcagugucuaaugacgaugacccguucaaguauuuugccccuacuucggguggccucaaaaaggucaaagcucggcagguucgaaucgaugaaauugggagagugcuggaccccggauucccagccaggaccgcucgccggaagacaagaggcuga

SEQ ID NO: 2764 - RNA, 3333 nt, Artificial Sequence
  Cas9 variant
augaccgccagaacacacaagaucuggaggcugggcgcugaccucggggcaaacagccuuggaugggccgcgauugagcuguccgcucccguggaugguaaaccuauagccaucuugcaugcaggcucucggauuuucucagacgggcgcgauccaaagaguggagccagcuuagcugucgaccgacgugaugcaagagccaugaggcggcgcagagacaggcugcagcaacggcagcgcgcucuaaucaaauaccucauugccgauggccuguuuccggcggacgaaaaugagcgaaaggcaauggccacuaucgaucccuaugcuguuagagccagggcacuugacgaagcucugacguugccugaggugggucgggcccucuuccaccugaaccagcgucgcggguuuaaauccaauagaaaggcggauaggaaggccgacgaagaugcaggaaaaauagcuaucggcauugaccggacccgagacgccauccgccaggcugaggaggaagccggcgcagagccagggucuuggacauacggaaaguggcuguaugaaagaagggccucggcuacugaugcgaacgcaauucccucaguacggacccgccucagaccugagacagacgagcaugccaaaggugauggcuacgacuucuauccagggagggcuuuaauggaagccgaguuugcagccaucugggaagcucaagccgcacaccaucccgaugcgcugaccaaugaggugcacgaccgucuucacgaaauaauuuucuaccagcggccuuugaaggcuccacagaucggagucugcacucugauucgaggcgaucagagacuaccgaaagcccauccccucuuucaaaagaggcgccugcuugaggagcugaacgcauugacaaucgugcggccuggugaaauggcccagagacucaccagggaggaacgcgacacgcuguucuuaaagcugaaagauaaggcuaaaguuagcuuugugagucuccgaaagacucuuaaacuggacccagaugcccgguucaauaaggaguccgaaaaccguucugacuugaaaggggacgaggucgcagcugccaugggagcgaagaccagauuuggcaauaggugggugcaccuaagcaucgaggaacagugggauguaauugcccgccuggaggaaguugaguccgacgcugaagaugcagccugucgggcuuggcucgccgcaacauucgaccugacucccgagcagauaagagcggugaccaacgccccucuuccacccggcuauucaagguuugggaaggucgcuacacaacgacugaucgaugccuugcgcgacggagagaaagauggucgggugcucguguacagugaagcagucgcugccgcaggccuggggcaucacagcgacuuaagaaccggagagauuuucgaagaugcccagggcaggccgcagcugccuuacuaugguguugcucuagagcgucacaucaugcccgggacgggcaauccagaccauucugaugagaugcgcauaggacggcucacuaacccuacagugcacauuggccugaaucaacuuagaaggaucguaaacaccuugauccgagcguacgggcccccagccgaaauugcaaucgagcuggcucgggaacucaagcugacugacgaugacaaaaagcgcauuaauaaagagaacaacgaaaauagacuugccgccgagaagagguccgagaagcuguugacaauaggacggcccgacaccggugcuaaccgagcacuccugaaauuaugggaggaacugaauccugccaacgugcuagauagacgcugcaucuauacgggcacccagauuucagucgacaugcuguucagcgcggcuguggaaguugaucauauccucccauuuacagccacucuugacgauaguaaugggaacaagaucguguguaugagggaggcaaaucguaccaaacggaagcagucuccguacgaagccuggggacacacagacagaugggaggagauugcugcaagggccgcgcaguugccccgcaacaaacgauggagauucgaaccugaugcuauggagaaguuuaaggacgaauccggcuuccaagcccggcaucuggucgauacucaguaucucgcaaggcugagccgcgaguacuuagaaacccuguauccagguucgggggaggggucuucccacauaugggugucacccggacgucuuacagagaugguaagacggaaauugggccucaaugaccugcuaccugaucacaacuuugggggaggugccgaccaggcuaagaauaggcuggaucaucgccaccaugccaucgacgcaguuguggucgcuauuguggaccgaaguaugcucaccgaaaucagcagagucuccggccuggagggggccgaaggacgggagaggauuaucauaccacccccgugggaugaguuccgcaacgaccuuagaacugcggugaaugccaucacgguuucucacaggacagaucacggcaccauuagcaaagcagguuugccuaaggggaaagacgcuacugccggccggcugcauaacgauaccgcuuacggauuuacaggcgaaaccgacgcaaagggcaauucaaucgugguacgucgcgucccauuagccaguuucaagaaacucgccgaucuggaccgaauuagagauacugaccuuaaggcugcgcuguaccagcacuuggagggacucgaaggcaaagcauuugagaaggccgugauggauuuccccaaccuggaauggcauccuuuugguaacguuaggcgggugcgcgucacagaggugcuauccguaauccccauaagcgaccaaaaugggagaauuuauaaaggauacaagggcgacucuaacuauagguacgaugugugggagcugccagguggcaaaugggaagcugagguugucucaacguucgacgcccaccagccugauugggugaguaagauccggagccgaucccccaccgcaagaaaggugcucucucugcagcagaaugaccuuauugccgucgaacgcgcucaugagacuagggaauugaugcggguugugaaauuucgucaaaacggggagaucacauucgcgccaccgcaggaggccggaucgcugaagagaagggaugcaaccccuaaugaagacgaucccuucaaauauuuugcuguggccgcaagcuccuuacagaaggccaaagcucgccagguacggauagacgagcucggccgaguccuggauccaggguuccccgccagaacagcgaggcgcaagacucggaagucaaccuga

SEQ ID NO: 2765 - RNA, 3333 nt, Artificial Sequence
  Cas9 variant
augagaauccugggcuucgacauugggauaaccagcaucggaugggccuacguggagggugaagaacucaaggauugcggcgucaggauuuuuacaaaagcugaaaacccccagaauggggacucccuugcagccccucggcgcgaggcgcgaggaguucguagaaggcuggcucggcgcaaggugagauugaacguaaucaaaagguuacuguguaaggaguucggccuaaaucucucugauuauuuugccaacgacggugagcugccaaaagcauacgagacuacgaaggauaccaagucaccguaugaacuucggagucuggccuuggagcaaaaacucgaacccaaggagcuggcucgcgugauucugcacaucgcaaaacaucgaggguacggaaauaagcacgccaaaagagaccucgaggcugaagagaaggccaagaaagcggcagaaaaggccccucaggagaaagaaagcacaacuaccaacggcgauuccaagaaagagcaggagaaggucuuaaaagcucuguaucagaaugaaacacuuuugaagaaguaccaaaccaacuaucagacuaauaacaaaacaaaugacgagaccaacaauaagacgauauuccuggugggcaaauaccuauacaaggaauuucaggauaaagggcagaggauccggaacacuaccaauaacuaucaacauacaaugcgucaggaguggcucaaggacgaacuggaguucauuuuuaagaaacagaaggauuucggagccacuuuuucugagaacuucgaaucgcagauccuugagaccgcauuuuaccaacgcgaccugaaaucauucgaagauaagguugguaaaugcguguuuuaugagaaugaaaacagagcuccaaaggacagcuugagugccauggaguucgucgcgcucacaaggauuaucaauacccugaagaacuuagagaaaaaguccaaaaaucugggcauaggggaaacguacggaaaggacaaaauucaggagauccucaagauugugcuugauaagggcgaaaugucuuauaaagagcugcggaagaucuugaaacuaaacgagagcauccuguucgccaaggacuccaaacucgauuacacuaaggguaugcaggaagcagagaaagcuaaguuuauugaacugaagaaucuuaaagccuucaagaaagcuaugggaggggacuuuucaaaguucccccgagaggaacuggauaaaauagccacagacaucguauugauuaagaguaaggagaaccucgcaaagaagcugcaaaauuauagcgccuuaucuaaagagcagguugaagcucuguccaaccuaaauuuugcgaagcacaucgaucucucacugaaagcacuugacaagauauugccuuucaugcgcgagggccugagcuacgaugaaguggucaagaaagugggccuccaggagcauagaaaguacaaacagaagggggaauuucugauuccacuuaaagaguaugagcccuaccuggccaacccuguggucgcuagggccuugagugaauaucggaagguucucaaugcacuguuacgcaaguacggaaacgugcacaaaauccaccuggaguucaccagagaagccgguaagaauuaugacgagaggaaaaagaucgaaaaagagcaacgugagcauuuugaagcuaaccagaaggccauuaaacagcgggagauccuaggccucccaauuaacggggcaaauauacugaagaugaaacuuuggaucgaacagggagaguguugcguauacucuggcgagaaaauuacuuccaagcacuucuuugauagcaacgcguugcaaguggaccauaucuauccguacucgcgaucuuucgacgauuccuacaugaauaaaguccugguguuugcuaaggaaaaccagaauaaacucaacaagacacccuucgaggccuucgguucagacaaggaaaaaugggauagaauccugaguuuaagcgcaaagcugccuaaacagaagcagaggcgcauuuccaauaaagacuuuaaggauaaggagcuuggguucauagcccggaacaucaaugacaccggcuauauugcuagauuggccucucaauggacgaacaauugucucaaauuugaagaucugagggagaacgagguuaccaucgcaggagaaaagggcagcaaaaaucaccuagaggugauuucagggcagcugacaaguaugcuccgccacuacuggggacugggugacaaggaucgaaacaaucaucuucaccaugcugucgacgccgugaucauagcguauacuaacgccaaaaccaucaaggcuuucgcagauuuuaagaaaaaccaggaacagaaucgggccaaguucuacgcuaaacaaauuuccgagcaggaauauaagcgucagagaaacccauuugagcccugcgccaauuucaggcaacgcguagaggagaaaaucaacaagauuuuuguuagcaagccuccacggaaaagagcaaggggcgcguugcacaaggaaacauucgggucuaucugucuggacggaaauaacaauuggguggcccgauuuaaaauaaagaguaaaaaggaacaggaggauauuacuaaagaaaaggcuaccaaggccaaauacaaggacgaguucaaaggcgaggaaaacauccgcaaggcauuaaaacucgguaagauucggagaaucaauaacacacagaaggacauagcuaucggggauaaaauugucaagaaugagaccauggugagggucgacaucuuuaaagauaagaaaggcaaguucuaugccgugcccauuuacacuauggacuucgcacugggaauccuuccgaacaaggccguugcuacgggcgaagaugaggacggggugauaaaagauuggauugagauggacaagacaaaauacgaauuuugcuucucacuguuuaaggaugacuugaucaaaguacguaagaagaaaaugaaggaggcggaacucuguuauuucgucggauuugauaccgacgguagccgcaucauuguggccaaacauaauaacgauuaccagacuaugaccgagaaugaaugcaagcuguucacacuaaaagagaagaaaaagaagcagaaaacccugaacgacgaggaagacaaccaagagcggaucgaaacugaguauaagauuauaggcgggagaacaggaauccagaaucucgaaacguuugagaaacaccagguuuccccucugggcgaggugcaaaaggcagaguucgaagauaggcaggaaauuaaacuuaagucuucgcccaaggguaaagacuga

SEQ ID NO: 2766 - RNA, 3333 nt, Artificial Sequence
  Cas9 variant
augagcgagaaguacagacugggccucgacguggggaccaacucccuuggaugggccgucaucggucugaaagaagauguucccucuucaguguuggcuacaggcguaaggauuuucagugaggggcgggacgcaaagacuaaaagcacguuaaaggccucccgcaccgaaaaacgaucugcgcguagaaggcgggaucgcuuucugcagagacaaacauuccuaauaucggagauggugaagucaggacucuuuccuaaggacaucgucgaacagaaaaaucuggagcuucuggauccauaugagauuagguucaaggcuuugacugaacaggugccgcuccaccaucugggccgggcccuguuucacaucaaccagcgccgagguuucaaaagcaguagaaaggacaaauccgaggaaaccacaucugggguugugagcaaguccgucagggcacucuacgaggagaugcaauuaauuaaucccgccccugugaucgaugacccaaaggcucugucaaaagaagaacggcgugaaauacgcguacaggaggcaaguagcagagaagaggcccuuguuaccuuggcugagcagaagggagugacuuuuggcgccuuccuguauaggcggcuacagucuggcaaauccguccgagcgcgcaaggaugcagacucacaacucuacgauguguaucccacaagagaacugcuuaaagacgaguacagcaagcugaugcagcaucaggcccaguauuacccuaacgugaucaaugaggcuuugauuaguaggcuccacgaugucaucuuuuuccaacggaaacugaaggagcaggaacgcggguuuugcaccuacuauccaucugagagaaggacguuccguuguaugcccuccuuucagcaauaccggaugguucaggaguuaaacgcccuggaauggguggacgcagcuggaaagcauugccuccgagacuauccugagagcagagaucuuauucugucggaauuggagaauaucucuacuaaagccggugaguucaccuucggcaacaugaagaaaauacuaaagaaaauggggguaauugacggagaaguguccuuuaauuucgagggcccaaagaggaaggguuuucaggggaacgucacaucacgcgaaaugcggcacgaggauuguuucggaacuagaugggacgaacugagucucgaugagaaagacgauaucauugacaagaucaaugaugaccaccuggaugacgaggacauggaaagguaccuuaucgauaccuauggccugagcuccuuuucugugggcaacgcgauuaaugcccgcuugcucgaggggacagcaaacguuagccgaaaagcugcccggacccuguacgaaacgauguuaucagcuaauugccugcagagugacgccgugauagcagucuccgagcaagaugacacuuucgugaacccguauagccguacaggaagaggugaacuacucucugagcugcccuacuacggcgaggccuuucaggaugggaggcauaucauuccuggaaagcgcgaaccaaaaguaucacacgaccagcuuaaguucuauggcgguguuaguaaccccaccgugcauaucgcuuugaaucagauacggcuggucgugaacgagauuaucaagagauacgggcucccuagcuccaucucuauugaacuggcgaggaaucuuccagagggccaagauggacgacgcaaaaucgaaaagaugcagucggagaaccagaaaaauaacgagcgguaugaccagauucugacugaaaauggccaaagccccaacagagauaauagguugcgucucgcacugugggaggaauuaggggagggaccgacagaccgccugugugucuuuaccgguaagcuaauagaacucgccgaucuguucaacggcuccguggagaucgagcaccuuauuccuuuuucaguuaguuuggacgauucuaaagcuaauaagacggugugcuggaaggaagccaaccgguucaaagggaauaagacccccuacgaggcauuugccaacaauagcggagacuauuccugggaagagaucauggagagaguaagggcucugccaaacucaaaacaguggcgauuccaggaagacgcccucaagaucuggaacagcgaucacucugacuucuccggccggcaucugaaugauacacgcuacauuaguagauuagcaagggaguaucuggaaaacauauguccuuuuaauaaaaucgacgucgugacuggucggcuuaccgcguugcuccgagggcacuggggccugaacaauauucuaagaggacauaacgagcccgaaacagcuacuccaaagaaaaugcgcgaugaccacaggcaucacgccaucgaugcaguugugauugccaugaccagccugacaauccuccagaaggucucuuccgcugccggcaaggcagaggagcuggacguggggaaacuuuucgcuaaggaugaaucaggacguaguguaauagaccccugggaugguuuucgggacgagguggccgaaaaaguuagaaauaucauugucagccacaagaccaaaaggaagacuaucggcaacucggggaaguccacggaucgcgcguugcauaaugagacagccuacggacugauugacggcccugacgaaaaagguuuauacucuguggugaccacuaagccaaucagcuauuucgauaaccgagacaaaauagagaagauuagagaugagaaacuccgggacgauuuucugaccgcuugggacggggaaggcgauaauaaggcaucacaacuugccguccuggacaaggcuaguggauugaacguuaaaaagugcagguacguggagcgcaaaaaggugaucccgauuaauggccccgaugggcagccuuauaaagccuacgacggaaacuccaauuggggcauggaaaucuaugaguucccaaacggucaccccaaggaaaagaaauggaacgggguagucauaucuacauacgaugcaaauaagagcgaguuuaaaccuggagagaccuuccguccacaucccgcggccaagcucgugaugagacugcacaucaacgacauuguugaagugcagaaugacggcgagccgauccuauaucggguccaacugauuuccgcugguacucucacagugucaccucugcacgaagccaacguugauagcaggaaucgcgacaaacaugaugaguuuaaguacaaaagucuuucugugacgccaaugcagaagaugggcgcaaagaaaguaaacaucucccccaccggguugaagaauuacagccgauga

SEQ ID NO: 2767 - RNA, 3345 nt, Artificial Sequence
  Cas9 variant
augggcaucauuauagggcuggacaucggaauugccagcguggguaucgcugucguugauaaggacacccucgauauuaaaugcgugguauccgaccuuuucgauucugcagacgccucaaagaacaucgagagaaggaauaaccggcaggcgcgccgacugaaucguagaaggaaaacacggauaggcgauuuuaacacuuugugggugaguauguucggggaauuacccgaggaagucgacagcaaugugcugcuacuccgcaacgcuggacuggaugagcaacuuacgcuggacgaaaucuacuguguuuugaaguauaugcucaaacacagaggcauuuccuaccuggaggaugcccugaaugaggaaaacgugaccgguucuuaucagaaggggaucgcaauuaaucagagggagucggaauacaugcucccuugcgagauccaguuagagcgguuucgcaaguauggacaauaccgaggcgaaugugaggccgaaaacgagaauggcgagaaaauaacacugucaaacgucuucaugacuaauagcuauagaaaggagauugacaaauuucuuaacacccaggggaaguacggaaucuugaaucagaaauucauugaugaguaccugaagaucuuuaacaggaagcggaaauauuacgaagguccaggcaacgagaagagucguacagacuaugggaaauacaccacuggaaaggaccuagauggcaaauauaucacagaaaagaauauuuucgagaaacucauagguaagugcuccguguacaaggaagaacugcgcgcugcaggggccucuuauaccgcucaggaguuuaacauccuuaaugaccugaacaauauuacgguaaacaauaaaaaguugacuacccaacagaaaaaggauguuaucgaaauagugcagaacagcgacagaauuaauauggagaaaaucaucuccucauguauuggagaaaagaucgagaagauugaaggcgccaggauagauaaaaacgagaagaauaucuaccauacauucgagcaguacaacaaaaugcggaagauuuuugcggagaaaaauuaugacaucaaggaacucacuaucgaacaacuggaugagauuggccgaauauuaaccaucaacacagagcgcgaagggauuaaggacgcaaucauggagagugaacugcuccaccuuaauaacgagcagauuaaccuguugaucgaacuaagauacaaaaauagcucucuguucaccaaguggcagucccucucaauaaaagccaugagggagaucauuccggaucuguaugaccggaacgucaaucaaaugaacauccuugcugagcgcggaguguuuaaggauaaaauuaaucuguucgaaaacagcguguacuugcccaaggagccuguccucgaagagaucuauaauccaguugugagaaggaguauaucuaugacgauugacgcccugaacgcauuaaucaagaaauacgguuaucccgaagacauuguaaucgagaugccucgugaucggaaugacgcugagcagaaggaucgaauaaagaaguuccagaaaacuagagaaaacgagcugaagaauaucaaaaagaagauuaaagaagaguacggcaucgaaauuacagacgaguacuuuaggaagcauaaagggcuagagcucgaacugaaacuuuggguggagcagaacgaaaaaugcccauauuccggaaaguacaucaauguccaagauauauuguaucaccaugagcuguucgagauugaccacaucaucccccucagcauuucguacgaugacucucgcaacaauaaggugcugguuuauaaagaagagaaccaggauaagggcaaccggaccccucuuauguaccuguccacugugaauagacaguaugaccagcacgaauuuaugaacuacgucuugucaacaaaaacccucccaaggaagaaacgcgagcuguuacugaauuacgaagauaucacgaagauugacgugcuaaaggguuucauaaaccgaaaucucaacgauacccgguaugccagucguagcguacugaaugcgauccaauuguuuuucgggggcaaagagugugacacaaagguuagagugauuaggggagccgucacuaaccagcuucgcaucaaacugaaucucccgaaggaccgggagaaauccuacucucaucacgcaauugaugcugccaucaugugcuauagccagaugggccugaugaacuuuagaaauauacagaacaaguucaucgacuuugaaaaugagaccuacuuaucagaugaaagggacaguuguuucgauaacaaguauuacgacgaggcucuguuugggcaagugcuuaaaaugcgaaagaauuugcucaaagccgaaggaaagccccagcgcuccguccagagcaaagguguguucgaugaggaggaaaagaacaacggcauuguucgguaucaucacaaaguggacaagaagccuaauagagggcugucuaacgcaucaaucuacggaacaaggaaaauugaugacaagaucuacaaaauaguaggcuaugauauucguaauaacaaggacgccgaggcuaucaucaauauuaucaaaaaggguaagagugauaacuuucuaauggcgaaacacgacccagaaacuuucaagaaucugauggagauauacgaacaguauaaagaggagaagaaccccuuccucgcauacgaacaagagaccggggacuauauucgcaaauacgccaagaaucauaacggcccuaucauuaagaaaaucaaguaugucgauagcgaagugggauccugcauagacaucucugcuaauuacggcuacaaaaacggggauaagcggguuauuauggacacacugaccccauauagagccgauguguacuauaauuacaaagacggaacuuauaggaucauuggugucaaguacgcagauuuuaaguauucgaacgccaaauacgugcuugacgaggaggcuuacgccuugauccugauaaaggaaggcuuacucaaaauuggggauagccuggagaauaucuccucaaguggauaugaauaccgacuuucuuucuauaagaacgacaucauugaguacacgaaaaaugauaucguauauaaggaacgguuucugagccgcacaaugcccaaggugaaaaacuacauagagaccaagccgauuuccgcagcguuguaugagaaaagaaacccuaucggccucacuaaugcuaccaacauuuguaagaucuacacagacguucuggguaaugaaaccaaaauauacaaggagaaauucaagcuaucagucgacuga

SEQ ID NO: 2768 - RNA, 3345 nt, Artificial Sequence
  Cas9 variant
augaacuacaccgagaaggaaaaacuguucaugaaguauauccucgcccuugacauuggcauagcuagcguggggugggcaauccuggauaaagaguccgaaacagucauugaggccggaucuaauaucuuucccgaagcgucagcugccgacaaccaguugagaagggauaugcggggugcaaagcgcaauaaccgacguuuaaaaacuagaauuaaugacuucaucaagcugugggagaacaauaaccuaaguauaccucaauuuaagagcacggagaucguuggccucaaagugagggccauuaccgaagagaucacacuggaugaacuuuaccugauuuuguauuccuaccucaagcaccgggggaucucuuaucuggaggacgcucuggaugacacuguaucgggaucaagcgcauacgccaauggccucaaauuaaacgcuaaggagcuggaaacccauuauccaugcgagauacagcaggaacgccuuaauacaauugguaaauacagagggcagagucaaaucauuaacgagaauggagaaguguuggaucuguccaacgucuucaccaucggcgccuacaggaaggagauccagcggguguuugagauucagaagaaauaucacccggaacuaacugacgaguucugugauggcuacaugcucauauuuaaucgcaagcgaaaauauuacgaagggcccggaaacgagaagucuagaacagacuaugguagguucaccacgaaacuggaugcgaacggcaauuacaucacugaagacaacauuuuugagaaacuuaucgggaagugcagcguuuauccugacgagcugcgggcagccgcugccuccuacaccgcacaggaauacaauguguugaacgaucucaauaaccugacaauaaauggacguaaguuagaggaaaacgagaagcaugaaauugucgagcgcaucaaaucaaguaauacuaucaacaugagaaagauuaucagcgacuguaugggcgagaauauugaugacuucgcuggugccaggauagauaaaucugggaaggaaaucuuucacaaauucgagguguauaacaagaugcggaaggcgcugcucgaaauuggaaucgacaucuccaauuacucacgagaggagcuugaugaaauuggcuauauaaugaccaucaacacagacaaagaggccaugauggaagcauuucaaaagagcuggauugaucugagugacgauguaaaacagugcuugaucaauaugcgcaagaccaacggcgcucuauucaacaaauggcagucuuucucccugaagauuaugaaugagcucaucccagaaauguacgcccagcccaaggagcaaaugacgcugcuuacugagauggggguuacaaaaggaacccaggaagaguuugcuggucugaaguauauaccuguggacgucgugagcgaagacaucuucaacccaguggucagaaggucgguucggauuucuuuuaaaaucuugaaugccgugcucaagaaauacaaggcacuggauacuauuguaaucgagaugccccgcgacagaaacuccgaggaacagaagaaaaggauaaaugauucacaaaaguuaaacgagaaagaaauggaguauauugaaaagaaacuggccgugacauacggcaucaagcuaaguccuagcgacuucuccucucagaaacagcucagccugaaacuuaaguuguggaaugagcaggaugggauuugucuguacucaggaaagaccaucgacccaaacgauauaaucaauaacccgcaacucuuugaaauugaccauaucauuccccguaguaucuccuucgaugacgcucggagcaauaagguccugguguaucgaucugagaaccagaaaaagggcaaucagacgccuuacuauuaccuuacccacucacacagugaguggagcuuugaacaguauaaagcgacaguuaugaaccuguccaagaagaaagaguacgcaauaucuagaaagaaaauucaaaauuugcucuauucggaagauaucacuaagauggacgugcugaaagguuucaucaacaggaacauuaaugauaccagcuacgccucccgcuuaguccugaacacaauccagaacuuuuucauggcuaaugaggccgacacuaaggugaagguaauuaaagggucauacacccaucagaugcggugcaaucuaaagcucgacaaaaacagagaugagaguuauucucaccaugcaguugacgccaugcugauaggcuacagcgaacuuggauaugaggcuuaccacaaguugcagggcgaauuuaucgauuucgagacaggggaaauucugaggaaagacaugugggaugagaauauguccgacgagguguaugccgauuaccucuauggaaagaagugggcaaacauccgcaaugaagucgugaaagcggagaagaacgucaaauacuggcacuacgugaugcgaaagucaaaucggggucuguguaaccaaaccauucguggcacuagagaauaugacgggaaacaguacaagaucaauaaauuagauauaaggacgaaggagggaaucaagguuuuugcuaaacuggccuucagcaagaaagacucugaucgcgaacggcuuuugguguaucucaacgacagaaggacauucgaugaccugugcaagauuuacgaggacuauuccgaugcagccaauccauuuguacaguacgagaaagaaaccggcgacaucauucgaaaguauaguaagaaacauaacgguccccgcaucgauaagcuaaaauacaaggacggggaggucggcgcuuguauagauauuagccacaaauacggauucgaaaagggcucuaagaaagugauccuggagucccucguuccuuaucggauggacguguacuauaaggaagagaaccauucauacuaucuggucggggugaaacagagugauaucaaguuugagaaaggaagaaauguaauugacgaagaggccuacgcaaggauacuugugaacgaaaagaugauccaaccaggucagagccgugcugauuuggagaaucugggcuucaaguuuaaauuaucguucuauaagaacgacauuaucgaguacgaaaaagaugggaagauuuacacugagcgccucguuucccggaccaugcccaaacagagaaauuauaucgaaacaaagccgauagacaaggccaaauuugagaagcaaaaccuggucggacuuggcaaaaccaaguucaucaaaaaguacagguaugacauucuggguaauaaauacucuugcagcgaagagaaguuuacuucauucuguuga

SEQ ID NO: 2769 - RNA, 3348 nt, Artificial Sequence
  Cas9 variant
augagcgccaccuacacaaucggccuggacauugggauagcuuccgugggauggugcgcauucggugagacucacauccucgaucuuggcgucagagccuuugacaaggcggaaacggcuaaagagggggaaucucugaacuuggccaggcggaaugcacgcuuaaugcgacguagacuguucaggcggaccuggcgccuaaagaaacucgccagacagcugaagucagagggacuuauugcugauacaaaacuguuuaagcccgaauugccuuucaguaagagccucuggcaacugaggguugacggccuggaucggcgccucaacgacgaggagugggcacgagugaucuaucauuuauguaaacacagagguuuucauuggauuuccagggccgaagcuaagcaggccgagggggauucuaaaucggaaggaggcaagguaaaacagggccuggcggggacugcaaaacuuauggacgagaagggauaccggucagccgcugagaugguguuggccgaguucccacaggcacaacguaauaagcagggugaguaucagaaggcucugagccgcgaacuacucgccaaagagcuggcgcuucuguuugcccagcaaagagaauacggcaacuugcacaccccgggggcacucgagacagcuauccugggaaauggcgauaagaaaagugguuuauucuggcagcagaagcccgcccuggcugggaccgaccuccuuaaaaugcugggaacuugcacauuugagaagggcgaauauagggccccuaaggcauccuucaccgccgagcggcaugucugguugacgcgacuaaacaaucugcgcauagugacugauggcguuaccagacagcucacagaacaagagaggcagcugugucuuccacugcccuaccggcaggcuggggacuugacuuauaaacaacucggaucugcgcuggcaaaggccgguuuacuggaagcuggcggguuuaaauucaccggacuagccuacccuacagaggcacagaaggccgagggcaaagcuaaggauccagaaagcgccacccucgugaagauccccgcauggcacgagcugcgccagacgcuuacuaaagguggguugaacgacgaaugggagaagcuggcgggcgacgcucucugcggacagccugaaauuuuugauaaaaucgccuggguccuguccguguacaaggacgaugacgagguaagagcagagcuugccaaacuggcuuugccaaauccgcaagcccucacagaagcacuguuaaacauuagguucgauaaguuccacucacugagucuaaaggcucuccgugccaucguuccccauauggagcagggccugcgguaugacgaagcgugugugcaggccggguaccaccauagccagcuuuugaaagucggagagggugagcacaaguaucugccuccacucuacgauggccgagacggggauggaagaaugauauuugcugaagacgcagauauucccaggaauccuguggugcugcgcucuuuaaaccaagcccggaaagucguuaaugcuaucauuagaagguauggcuccccaucagccgugcacaucgagauggcacgcgaccugagccgacccuucgacgaacggaacaagaucaaaaaggaucaggacgaguaccaggcgcguaaucagagagauagggaacaauuuagugagcuuuucggucauccgccuaagggguuggaguuugaaaaauggcgccucuaucgggagcagaacggccagugcgccuacucucagagaccccugaccgcuuccggaaacguagccgaaauuuuccuagacggcagcacugagauagaucacgcacugccauacucgaggucuuuugacgauuccaagaauaacaaagugcucguccugacacgagaaaaucgcgacaaggggaaccggaccccuuaugaguaccuuggaggugcugaaaauucagaaaguuggcaaagauucgugagcuuuguugaguccaacaaagccuauagguuggcaaagcguacgcgccuguuacggaaagauuucggcgccaaggaaucugaggaauuuagagagaggaaucucaacgacacccgauacgugugucgguucuuuaagaauuaugucgagcagcaucugaaacuugcugaagggagcgagacaaagcgcugcgugguaguuucaggacagcugacuaacuucuugagagcgagguggggccuccugaaagugcggagugauuccgaccgacaccaugcccuagaugcagcugucguggccgccuguagccacucuaugguccaaagacugucaaauuacagucgcaccagggaacucgaacaggugcgugacgguuucguugacaucgagacaggggagauugugaaccccgcuaugcaccagcagcugcgggagcauuuuccagaucccuggccuuauuucagacacgaacuugaggcaagguugaagaucgacagcccagaacuguuacgcgaggagauggcccgacucggcuccuacucugaagaggaacugaaaguacuuaagccgcuguuugucucgagagcgccccaacggaggaauggaggcgcugcccauaaggauacuauauacgggcagccugagaaacuaaagaaaaacggaagcgugacccagaagguugcacucacaucccugaccuugaaagacauugaucuguuagccgacccacaccgcaaugcuaagcucuauggcgcaauccgugaaagacuggaggcccacggugggaagggagauaaagcguuccccgcuacuaacccucuucggaagccagacaaagagggcaaccccacggguccgaucgugaggacagucaccaaggugauugauaaacugucaggcaucccuguacgcgggggaauugccaagaaugacacuauguugcgaguggauguuuuuaccaagggcgggaaauuccaucucgucccaguguacgugcaccauagagucacaggacugcccaaccgggcaauaaucgccuuuaaggacgaagaugaguggacccuaauugacgacaguuucgauuggugcuuuucucuguauccuaaugaccuucucaggaucaaacugaagaaagaaagccacuccggcuacuauucaagcuguaaccgcucuacuggugcuguuaauuugugggcccaugauagaaacgugaauguggggaaggacggauucaucgaguccauuggcguaaaaauggcagucaguauagaaaagcugcacguggauacauuagguaacaucuaccccgcuccaccugagaagaggcggggccucgccuga

SEQ ID NO: 2770 - RNA, 3351 nt, Artificial Sequence
  Cas9 variant
augagccagaaccagaaucccaacacccagucccaccugaauccuacaacucagucuucaacgcagaguaacccacaaccgaccacacaggagagccucaagauccuuggcuucgacauugggguggccuccauaggaugggcuuuugucgaagguggcgagcugaaagauugcgggguuagaaucuucacuaaggcagaaaaucccaaagacggaucuucguuggccuuaccuaggcgggaggcgcgcggcgugcgacguagacuggcuaggcggaagggucgccuaaacgcccucaaaguacugauuuguaaggaauuugggcuuaauagaucagauuaccuggcaaccgccggagaguugccaaaggcuuaugcaacaagcaaagagaccaagagucccuaccagcucagggccgaaucccuggagcggaaacugucugcugacgaguucgcccgcgugauccuccauauugcgaagcaccgaggcuauggcaacaaacaugcaaaggaaagcuccgaugacgauucagggaaggucaaaaaggccaucagugagaaucagaaagugaugagcgaaaagggauacacuacagcuggucaauauuuauacggcgaguuuuaucagaaagccagaaacuucucugaagcagagccuaagucccccaaaaaugcuagggggacccaggaauuuaagaacguucggaauaagucagagaacuacgcccguugccuggcgcagagcgagcuucaaaaagaauuggagauaaucuucgccaagcagcgcgaauuuggauuccaguuuagugacaaaaagcacaaaacgauuaaugcaaacggcaagcugaaggagcuagauuucgcugacgccgugcucgaaaucgcuuuucugcaaagaccacuuaaaucuuucgccgauaaggucgguaaauguacuuucuacgaggacaagccuagggcaccaaaagauucccugagcgccauugaguuuguggcuuugacccggaucauaaacacacucgcgaauauuacuaagcgaucgggggaaguauauucugcagacaagguucgcgagauccuguccauuguguuagacaaaggagaaaucaccuacaagaaccugagaaaagucaucgcccucgaugagaggcuucaguucccgaaggacucaaaacuggauuaugcuaaggaagacgccgagaaggcaaaagccauugaguuuaguaaguugaaggcuuuccggaaggcccuaggcggcagcuuugaaggguucauacgcgcagagcuggauuccaucgcgacagacauugcucucaucaaaucuaaggaugaacugaaagccaaacuugcaaauuaccagagccugaacgacgagcagagagagaaguugucagaacucaguuuugauaaauucauagaccuguccuuuaaggccuuagaggcuauucugccccuaaugaggggagauaaagacgacaagaucuaucguuacgaugaagccuggcgggaggcaggucucguggaaguggcuaaaaagacccaaaagggcgacagccugccuccacuuaucgaguaugagaaagauuuggccaaucccgucguugcgcgagcccuggcugaauacagaaaggugcucaacgcacugcuuaaaaagcaugggaaaguacacaagauucaccuggaguucacgaggcaggccggagugucuucaaaggaacgcggcgagaucauugcugaacagaauaaacgguugaaggccaacgaggaggcaagaaaaaggugcgaagaguacggucucauaccuagugggaagaauauccugaaauuaaagcuguggcaggaacaaggcgaguuuugugucuauagcggaaagaaaauuacucaguccgaccuacgcgaugaaucuacacuccagaucgaccauaucuacccauauucgcgaagcuacgaugacucccagaacaauaaggugcugguuuucaccgaugcgaaccaaaauaaacuuaaccagacucccuaugaggccuuuggcaaggacauuucaaaauggaaucagauauuggggcggaucgagaagcugccgaaagcuaagaagaaccguauuacaaacaaaaauuucgccaacaaggaagcaggauucaucgcuagaaauauuguggauaccaguuacaucgccaggcucucugcaagcuauacggacgccuuuauagaguucugcccucuggcugaaaacgaggauaccacauuaggucgcggcgagaaaggguccaagaaacacaucucagucgugaauggaagccugacugcgaccaugcggcauuacuggggccuuaacacauugcucgacggugaaaauucugaguccaaggacagaaguaaccaucugcaccacgcccuagaugcaauuaucauugcuuacguaaaugacagcguuaucaaggccuuuucugauuucaaaaagacucaggaacaaaacaaagccaggcugauagcuaaggagauugaauccgcagaguauaaaaucucacgacgcuuuuucagucccagcggguuugagaauaacgaagccuuccggcaggcgauuaagagaaagauccucggccagucgcuggaguccagggaaaaugacaugaccauaaacucugaggcucuuggagaaaaagugggcgggaucuuugucagcaagccaccucguaaacgcgcccggggagcauugcacaaggagacauucucaaguauugaugacaaagaucuguuaaagaccuacgguggcaaggagggggugaauagagccaucaaacucggaaaggucaggcaaauuggcuccaaaaucgcugacaacgguacuauggugcgaguugauauauuucggcauaaggugucugggaaauucuauggcguacccauuuacacgauggacuuugcacugggaauccuuccaaacaaggccgucgugggcgggaaggauaaaagcggaguuaucaaggacuggcugcccauggauuccaauuaugaguucuguuucucauuguuuaaagacgaccucauucuggugcagaagaaagaaaugagcaaggcggaacuaugcuacuucgcuggcuuugauacaaguggugggcagaucaaagucgagaagcacgacaaccauuucgccacccugacugauaaucagcgccuccuguuuaacauugcaaccccuaaggaaguggccggaaaaucuauaggcauccaaaaucuuaagguauucgagaaauggcaaguguccccauugggugagguuagcaaggcugaauuuaaagagagagaaccgauugcccugaagucgacacccaagagguucuuacagggcuga

SEQ ID NO: 2771 - RNA, 3354 nt, Artificial Sequence
  Cas9 variant
augaagcacauccugggccucgaccuugggagcaacuccauuggaugggccuucgugcagcaagauuuugagaauaaacaggguaagauaaucgcuaccggcucuagaauuauccccauggaccaggggauucugggagauuucgaaaggggcaacacagucucacagacugcagagcggacgaccuaccgcaguaugcgacguuugagagaaaggcauuuacugcggcgcgagagacuacacaggguucuccaucugcuugguuuucugccuccacacuaugacgcccaaaucgauuucacaaaacgguacgggaaguuuauagacaaugcggaaccgaaaaucgcuuauaacaauggaaacuucauuuuuaugaauagcuucaacgagaugguggaggauuuuaagaagcaucagccccaguuguucuacaaaaaguccaauggcgaagagucucgcaucccuuaugacuggacuauuuacuaucuccgaaagaaggcccugucgcagaaaaucacccaacaggaacuggcauggcucauauuacacuuuaaccagaagagaggcuacuaccagcugagaggggaggaggaaacagagaauccaaacaaggaaguagccuuccacucacuuaaaguggucgauguggaggcugaagcacccaauaagaaaggagagauuugguauaccauccgguuggagaacgguuggauuuaccgucgcacuagcaagaauccucuggacgauuggaaaggcaagacaagagacuuuaucguuaccacggaucuaaacgacgacgggacuaucaaacucgauaaggaaggaaaggagaaaaggaguuuccgggccccagacgaaaacgauuggaaucugcuuaagaaaaagaccgagcaugacauugauuucuccggcaaacccguggguacauauauauacgaccaccuguugcaaaacccuaaucagaagaucaaggggaaacucguccgaacuauugaacgcaaguauuacaaagaugagcugaaggcuaucuuagccaaacagauagcgcugcaaccagagcucuuuaccgaaacacuucuggcagacugcauuagagaguuguauaggaagaacgaaacccagcagcagaaucuacugucuaaggauuuccuccaucuguuuguggaggacaucaucuucuaccaacggccgcuuuguagcaaaaaguccacgauugccaacugcacucuggaaaaacgcucauacaucgauaaggagacaaaugagagaaaagacgcucccauuaagguaugugccaagaguaacccuuauuaccaggaauuuaggguuuugcaguggcuccagaaucugcguauauaugagaucgaaaccgaccgggaggugacugcagaguucauugaaacaccacaagauuacgaggcuuuauuuaacuuccugaugagccagaaagaaaucgacaaugagggacuacucaaguauuuucuguucgccaaaaacccccagaucaaggauaaagcggccaagucugaacuuaaaaagugguugaccacguaccgauggaauuaugucuacgacgcagcugauaacuccucaaagaaauacccuaugaaugagaccggcuaugagcugcagagauaccuccaaaagguggaaggccugccagccaacuuucuuacauucgacauuacuuaucagcuguggcacuugcucuacagcgugaaagauaaggucgaguuugaaaaagcucugaagaaguucgccaaaaagaaacaguuagacaagaccaguuucguugauucuuuuaaaaacuucaagcccuauccgaaugaguacggguccuuuagcgaaaaggcaaucaaaaagcugcuaccucucaugagguucggaaaccacugggacuuuaaucgcauagaugugucgacacagaaacggauugacgaucugaucaacgguguagccaaugaggacauuagaacuaucauaagggagaaggcugaaaaauaucaacuuaacucugagaccugcuuccaggacuugccccuguggcucgcgcaguacguggucuacaaucgccaugcagaagccacagauaucgagaaguggaccuccgugucagaccuggaggcuuauuuagaggauuuuaagcaacacagucugcgaaacccaauuguugaacagguggucacugaaacgcuucgggugguacgugacaucuggcagcaguacagcggcgggcaagccaauuucuuugaugagauucauaucgaauugggaagagagcucaaaaagacagcagaggaaaggaaacagcuguccgacaagaaccaggagaaugaaaacaccaaucuacgcauuaaaaagcugcucgccgagcugaaagaagaugcuucuauacagaacguucggccuuauagccuugugcaacaggaguugcugaagaucuacgaggaaggcgucuucucaaguacugacgagauugaagaggauauccagaagauaaggaaaaagguggaacccaccccacccgagauccagagguauaaauuauggcucgagcaaaaguacaaauccccuuauacaggugaagucauuagccugaccaaacuuuuuacugaggaauacgagaucgaacacauuaucccacagucucgauacuaugacgauucacugaguaauaaggugauaugugagagcgccguuaacaaauugaagacaaaccagcucgggcuggaguucauucaaaaucaucacggcgaaaaagugcgcaucacggcaaacaaggagguaaccaucuuuacugaggaacaguacaaagaguucgucaagaagcacuaugcgaauaacuccgcuaaacagcagaagcuacugcucaaugaaauuccggagaaaaugguggcccggcaacugaacgacacaagauacaucucuaagugcauuucggaaauacuuagcaaaaucguuagguccgaugagaaggacgaaggagucaauucaaagaacauuauccccuguaccggcaaaauuacaacugcauugaagcaggacugggggcugaaugauguguggaacgaguuaauccucccucguuucgagcgcaugaaucagcugacccagacgcaacuuuuuaccaguuauaacgaccggcugcagaaaaaucuaccaacagugcccauagaauacucucagggauuccagaagaaaagaaucgaucauaggcaccaugccauggacgcucucguaauugccugcgcaacucgagagcacaucaacuauaugaauaaccaacacgcucuggauaagagcaaggacaaaaaggaaaaacagcagucccggauugauuugcauccucuguga

SEQ ID NO: 2772 - RNA, 3354 nt, Artificial Sequence
  Cas9 variant
augcagaccaagaaccugcucuacacacuuggccuggacaucgggauugccagcgugggauggugcgucuugggugagaauagaauaaucgauuuaggcguuagguguuucgacaaagcugaaacucccgaucgcggggagucccugaacaaggugcggcgagacgcacgucuaaugagaaggcggcuccgcagaagggccuggcggcugacgaaacuugcgcgccuguugaagcacgcuggacucauugauucuacccgaaucguaagagacaggcaugauggcgccgugucaccuuggcaacugcgggucgaaggucuggaccguaaacucgcaccagaggaaugggcccgcgugauuuaucacaucguuaagcauagaggguuucacuggauaaguagggcugaggagcggaaggcagaaagcgauaaaggagagggcggcaaggugaaacagggguuauccgccacaaagcagcugauggucgagaaaaauuaccgaucugcugccgaaauggugcuuacugaguucccgggagcgcagcgcaacaagagaggugaauauaccaaggcauugucgaggauccugcuagccgcugagcucacaacccuguuugaacggcaacaggagcuuggcaauccccaugccgggccugaccugcagacuaaaauuuugggaaacggcgaucgcaagucaggucuccuguggaugcagaaaccacccuuaagcgggagugcacugcucaagaugcuuggaaaaugcacauucgaaagagaggaguacagggcuccuaaggccuccuuuaccgcggaacgucacguauggcugacgaaauugaauaaccuacggguucugguggacggcgucacucgaccacucucugaucccgagagaaggcuggcccuuagccugccuuaucaacaggcauccgacuucaccuacaagcaguugcgcgcugcccucuguaagaauggccuguuaccagacucauuucaguucagugggcuggcuuauccgacaggagcccaacagcccgaugguaaagcaaagaacccugaaaaugaccggcuagugaaacucccagccuggcaggaguuuagaaagacucugagggaugcuggccuugaaaccgagugggagagcaucgcggggauggcagccggaggccaacccgacuugcuggaucagauugguugggugcucucugucuucaaagacggggaugaaguucugcgcgagcuucgaaagaucccucugccaggcggagaaaagauggugcaggcuuuguccggcguaucauuugacacauuccacaaccucagccugaaagccuuacggaagauagugccccauauggaggcagggcugcguuacgaugaagccugccuagcugccggauaccaccauagugaccucagaaaagauaccgacgagaggucucuguaucuuccgccuuuguacuccggucgcacgacugacggccggauggucuuuagagaugacauugaugugcccaggaauccaguugugcugcgagcaaucaaccaggcgcgcacagucgugaauagcguaguucggagauaugggucgccuucuuccaugcacauugagauggcuagggaccucucacgucccugggaugaacgcaacaaggugaaacgggcccaagaggaauacagagacaggaacgagaagcugaagaucgauuucgcagccgaguauggaaucgaaccaaaaagucgagaguucgaaaaguuuuuacuguaccgggagcagggcgguaaaugugcuuauagccuuaagcccuuggaccucgaucgcguccugagagaccuaggguacgccgaaguggaucacgcacugccuuacuccaggucuuucgacgauagcaaaaauaacaagguccucgugcuggcugaggagaaucggaacaagggcaaucgaaccccauaugaauaccuugacggaacuucagagaguccgagauggcgcgaauuuaaagccuucguugagacaaacaaggcguauagguuggccaaacgugcucggcuguuaagaaaggacuuuuccggcaaagggagcgaagaguucagggaucgcaaucucaacgacacccgauacauuucuagauuuuucaagaauuauguggagcgguuucugaaacuugcagaagagucagaagagaggacgugcguaguccugaguggacaguugaccgccuuccuccgcgcucguuggggucuggccaaggugagaggcgauagcgaccggcaucacgcacuagaugcggccguuauagcugccuguuccaggucuauggugaagcgccugucggacuacgcacgaagacaugaacucgagaaaguccggacaggguuuguggauuucgagacuggagaaaucguagacgcuggcaaguauaggcagauugagcgcgauuuucccagcccuuggccauacuucagagacgaacugcuuaccagguugaacacagaugaccccgccgagcugcgggagcguaugcaauccuuagguucauacccuccagaagcacucgagacucugcgccccauguucgugagucgagccccgcagagaaggaaugggggcgcugcgcacaaagauaccaucuaucggcagacagaacgccuuaagaaaguuggaucugucacccagaaggugccucuggccgcacuaaaccucagagaccuggagaauuugguggacccacauaggaacgaaaagcuguacgcugccauacgggcccgauuagaggcucacggcgggaaaggagagaaggcauuucccccuaauaacccccucagaaaaccagaucgcgacggcaacccuacuggucccauugucaggacgguuacacuggugaucgauaagaugagcgggaucccagugcggggaggcguagccaaaaaugacaccaugcuucgugucgauauuuucagauccaagaaggacgguaaauuucaccuggugccguuguauguucaucacgcgguggcuaagcaacucccuacuagggccgucaucgcauacaaagaugaaggcgaguggacccccauuaacaaucaugacuucgauuuucuguucgcccuauauccaaacgaccuggugcgcauaacacuuaagaaagaacggcacuuuggguacuaugcuggaugcaaucgagcaaccggcgccguuucaaucugggcgcacgauagaaaccagaggauugggaaggacggauucaucgacggcaucggugugaagacugcucucagcguagagaaauuucaugucgauacacuggggaauguguaccccgccccuccagaaacgcgccggggauuggcauga

SEQ ID NO: 2773 - RNA, 3357 nt, Artificial Sequence
  Cas9 variant
augggcaccagauacagcuucgacaucgggacaaacuccauuggaugggccguguggaggacuggucgggaucccaagggcauauuuggggagaaagacgcuccucuggaacuccuuggagcaggcguccgccuguucaaggauggucgaaauccaaaagacgggcagucuuuggccacgaugcguagaaucccgaggcaagcgcggaagcgcagagauagguuuguuuuacggcgcgaggcucugguggccgcacuaauugaagccggacucaugcccgcuucagagaaagaacgaaaggcacuggccgaccuugauccuuaucagcugagagcugccggcuuggacaaggcgcucgcaccacacgagcugggcagggccaucuuccaucugcaccagcggcguggguuuaaaaguaaccgcaagaccgauagaaaaagcgacgauagggacaagggaaaaauugcuacagccuccgcagcucucgccaagaaguucgaggaugaaaaugcgcggacuuuuggugaguucuuauggcgacgccauagagaccccgacaugaaaaggcaggccguacugaaggcacacgauccugcuaaaggcaagccagaccuucgggccgcuaaauugcgccaacccaccagaaucaggcuggaagggcagggagccacagcacuauacgaguuuuauccuacccgugagaugcucugccaugaguucgaugcccugugggaagcucaggcgcggcaccacccaaugcuucugacucgagaagcaggcgacaagauaagaucuaucuuguuuaggcagcgcgagcucaaaccgccccugauugguuuauguacauucgaauacgccgcuggggagaaggagucgcggcugccuaaggcccucccaucagugcaagcaagagaaaucuaugagaggcuuggacauauucgccugagcaccggcaguggcacggaucgacccuugaaauccucugaacgggacgaucuagccacugcucugcuccacugcgggcugaccaagaucaaagucagcaagacaaaaggacuugccuuuaagacugaguuccguaaggcacugagauuggguggcgaagugaggauaaacuucgaggagaugggggaagagggacucguugaccugcgcaccaaucgguuacuggugcaggaugaccauuacggcccuagauggagggcgcuauccuggucagguaaagaugcuuuugucaagaaacuccuggaagccacagacgacgauaaacuuguggcacgauugaugaccgaggacgggcugagugccguacaggcucgcaacgccgcaagcauuccacuccccgauggcuauucucggcugggaccgacggcuaaugccgcgauccuucaggcccugauugacuccagagaugaaaacggcuucguugugacuuacgacaaggcugucaggcgugcaggggagcgcuugggaaaggauuggcaccacucagacgagcgggauggugaaauccucgacgcccugccuuacuauggcaagguguuacaaagacauauccugcccgggaugauggauccagcugacaggaaagaugaggccaaguuuuacggacgaauuaugaauccuagcgugcacauaggccuaaaccagcuccggcgccuggucaaugcacuuaucgaaagauucggucccccagaccagauuguuguggaguuggcgagggaccugaaaaugagugcccgggagaaggaacaagagcagcgaagaaaccgcgauaauagggaagcuaacgagaaacguacaaagaagcucguagaacuggggcaggacaauaacggcgagaaccgggccagauuaaaacuguaugaugagcagcaaagggcaggaaauggcguggcucauugucccuuuacccuugacccuaucgggauaacucaguuguucucuccagaaauugagaucgaacacguccucccgcgcucccgaacacuggaugacagcgccgcaaacaaggugcuaugcuuuagaaccaucaaucggauuaaaaggggaaagacgcccugggaggccuuccaugcugauccuaaauggccagacaucgcggccaacgcagaaaagcugcccccuaauaaacgcuggcguuuuagagaggaugcuauggacguuuucgaggcccggaccucggguaagauggauaagacaacucucgaacagaugggccugaccacaggguuucaggccaggcaccuuaacgagacuaaacacaugucucgcuuggcuaaggcauaccugggaaaaauuugugacccagaugccguguaugucacccccggcgcguuaacaucccuccugcgagguaagugggggcuuaauucaauacugagugacgacaacuugaaagauagaaccgaccaucggcaccaugcuaucgaugccauuacuaucggcgcaaugacgaggagccuccugcuagaacugaauacacucgccggaaaggcugagcaauccgacuacgaugacgugguaggcaagguuccguggccuuucgauaacuuucgcgacgcagugagaucugucguggauagggucgugguuagcaauaaaccagaacacgggaagcagggagcccugcacgaggacaccgcguauggcaucgugggugaugaggcugaagccgaggaaauugggaaccuuguacggcguaaauugcuggucgacuuaacucccggagagguggaccgcauacgagaugcaggccucagaaaggccaugcaggcugccguugcaccuucaagggacgcucgggguaaagugagugaugccaagggcuucgcggccgcacuggacaccuucgcuaaggcccaggggaugcgcagaaucagggucggaaaagaggauauguccgcugugacaauucaugaccggcaaaccgauaaggcauacaaagccguagcccccggcgaaaaucaccauguggacguuguccagaugcgagauggggcuuggaagggauuugcggugacuguguucgaggcaaaccagaaagacuuuagaccacagugggaacgcgagaaacuuggcgguaagcuggucaugaggcuacacaagggggaugccguugaacucgagagcucuggagugcggcuggugaaguucguacaacagaucuggaugaaaucaaauuugguccuguuaacagagcauaacgaaggcggugaccuccagaagcgucaccaagaugcugacgacccuuuuagaugggauuucgccaacauuggcaaacugaaggagagggggugcguggcaguuaaaguggacgaacuuggacgcgucacgaagcggaucaguaauaccuga

SEQ ID NO: 2774 - RNA, 3360 nt, Artificial Sequence
  Cas9 variant
augggcuacagaaucgggcuggacgugggaauuaccagcacagguuaugccguccucaagacugauaaaaacggccuucccuacaagauacugacguuggacuccguuaucuauccuagggcugagaauccacagaccggggcaucuuuagccgaaccgcggcgcauuaaacgaggacugcguagaaggacacggcgcacuaaguucagaaaacaaaggacccagcagcuauuuauccacucaggccuccugaguaagcccgagauugaacagauccuugcgacaccucaagcuaaguacagcguguaugagcugcggguagccgguuuggaucgccgacucaccaacuccgaacuguucagagugcuguacuuuuucauagggcauaggggauuuaaaucuaaucggaaggcagagcucaacccagagaaugaagccgacaaaaagcagaugggccaguuacugaacucgaucgaggaaauucguaaagcuaucgcagagaagggcuaucgcacugucggggagcuuuacuugaaggaucccaaauacaaugaccacaagagaaacaaaggauauauugaugguuaccugucaacaccuaauaggcagaugcuaguggacgaaaucaagcaaauacucgauaaacagcgggagcugggcaacgaaaaacuuaccgacgaguucuaugccacguaccuguugggggaugaaaaucgagcuggaauuuuucaggcccagcgcgacuucgaugagggcccaggugcggggcccuaugcaggagaccaaaucaagaagaugguuggcaaggacauuuuugagccuacugaagauagagccgcuaaagccaccuacacauuccaguauuuuaaccuccugcagaagaugacuagcuuaaauuaccaaaacaccacaggcgacaccuggcauacgcugaaugggcucgauaggcaggcaaucaucgacgcuguguucgccaaagcggagaagccaacuaaaacauacaagccgaccgauuuuggagaacuucggaagcuguugaaacuacccgacgaugcccgcuucaaccuggucaacuaugguagucuccagacucagaaggagauugaaacaguggagaaaaagaccagauucguagacuuuaaagcauaccacgaucugguuaaggugcuuccugaggaaauguggcaauccaggcagcuguuggaccauauaggcacggcucucacccuguauucuagcgauaagcgucggcgaagauacuucgccgaggaauuaaaucugccagcugagcuaaucgaaaaacuccugccccuuaacuuuuccaaguucgggcacuugucaauuaaaaguaugcagaauaucauaccuuaucuggagaugggacaggucuacagcgaggccacaacuaacaccggcuaugacuuuaggaagaaacaaauuucuaaggacacaauccgcgaagagaucacuaauccaguggugcggagagcagucaccaagacaauuaaaaucguugaacagauuauaaggcgcuacgguaagcccgaugggaucaacauugagcucgcccgagagcugggccggaauuucaaagaacguggagacauccagaagagacaggauaaaaacaggcaaaccaaugacaagaucgcugcggagcuuacugaacugggcauuccggugaacgggcagaauauaauccgcuacaaauugcacaaggagcagaacggaguagauccuuauacgggugaccagauucccuuugaacgggcauucuccgagggcuacgagguggaucauaucauuccauauucaaucagcugggacgauaguuacacaaauaagguccucaccucugccaaaugcaacagagaaaaggggaauaggauaccuaugguguaucuggcuaacaacgagcaacgauuaaaugcccugacuaacaucgcagacaauauuauccgcaacucccggaaaagacagaagcuacucaaacagaagcugagcgaugaggaacuuaaggacuggaaacaaaggaauauuaacgauacccguuuuaucacacgcguuuuguacaauuauuuccggcaggccauagaauuuaaccccgagcuggagaagaaacagagagugcucccacugaauggagaagucaccucgaagauuaggucucgauggggcuucuuaaaagugcgggaggacggugaccugcaccaugcuaucgaugccacuguaauugcagcgaucacacccaaguuuauacagcaaguuacgaaguacucccagcaccaggaagugaaaaacaaucaggcucuuuggcacgacgccgagaucaaggaugcagaauacgccgcugaggcccaacgcauggacgcagauuuguucaacaaaauuuucaauggguuuccucucccauggccggaguuccuggacgaacuacuggcuagaaucucagauaaccccgucgagaugaugaagaguaggagcuggaauaccuauacuccuauugaaaucgccaaacucaagccaguguuugucgugcggcuggcgaaccauaagauauccggccccgcccaccuugacacaauucgaucugcuaaauuguucgaugagaagggaaucguucugagcagagugucaaucaccaaauuaaagauuaacaaaaagggccagguagcaacaggggacggaaucuacgauccugagaauaguaacaauggugacaaagucguguauuccgccauucgccaggcucucgaagcccauaacggcagcggggagcuggcauuuccagauggauaccuugaauauguugaccacggcacuaagaagcuggugaggaaaguccguguggcgaagaaaguaucuuugcccgugcggcucaagaauaaagccgcugccgacaacgguucaaugguuagaauagaugucuucaauaccgggaagaaguuuguguucgugccgaucuacauuaaagacacggucgagcagguucugccuaacaaggcaaucgcuaggggcaaaagucuaugguaucaaauuaccgaaagcgaucaguuuuguuucucccuguacccaggagacauggugcauaucgagucuaagacaggcauaaaacccaaguacucgaauaaggagaacaauacuagcgugguaccuaucaaaaacuuuuauggguacuucgauggagccgacauugcaaccgccuccauccucguccgcgcucacgauucaaguuauacagcgcgaucuauuggcaucgccggucugcuuaaguuugaaaaauaccagguggacuauuucgggagauaccacaagguucaugagaaaaagcggcaauuguucgugaagagggaugaauga

SEQ ID NO: 2775 - RNA, 3360 nt, Artificial Sequence
  Cas9 variant
augaacgacaagaaaaaucugggcccccucaccuucggguuugauaucggaauugccagcguggguugggcuguccuuuccccuacaagaauaguugaccugggcgugaggugcuucgauaaggcagagacugccaaagaaggggagucuuugaacuuagcgcggcgcucagcucgacugaugcguagaaggcuacggcgcagagccuggaggcucaucaagcuggcacggcuucugaaacacgaaggauugauugccgacacgaagaccuuuauccagccaagugcuagccaugcauccccguggcaacuccgcaaggauggccuggaccgagcccugucucccgaggaaugggcuagaguacucuaccacuuauguaaacauagggguuuccacugggugucgcgggccgaggcgcguaaggcagauggggacacaaaaggagagggcggcaaggucaaacaggggcuggccucaacuaccaaacuuaugaaugauaagagcuaucgcacagcugccgaaaugguguuggcagaguuuccuagugcucagagaaacaagaggggagaauacaccaaggcccugucccgggagcuacucgacaaugagcugaaacagcuuuucgaacgacaacgcgaguaugguaacccacaugcggauacuaaucuggaagccaagauuagaggcucuggggaccacaaaagcggauuguuuugggagcagaagcccgcacucuccggcaacgaucuguuaaaaaugcuggguaagugcacauucgaaaagcaggaguacagggcuccuaaagccucauuuaccgcugagcggcacguuuggcucacgcgccuuaauaaccugagaaucauaguggacgggaggacucguccauuggccgacgcagaacggaccauggcccuaagucugcccuaugagcaggucggagauuucacauacaagcaacuccgagcugcgcuggugaaagcaggccuuaugccugacagcuuuaaguucgccucucuggcuuauccauccgaauuucagaaagccgagggcaaggcaaaggauccggaaucagccgcuuugacuaaacucgccgcauggcaggagcugagagcgaccuuaaagaaagcugaccuggagagcgaauggcagcaaaucaguugugccgcacuagaggggcagcccgaaacacucgaugagauugccggaguacugucuguuuucaaggacgaugacgaagugcuuaaugaguugcagaaacugggucucccuggcggggcuaagaccgagaacgcccugcuugauaucagguucgacaaguuucaugcacuguccuugaaagcucuccgcaagauugucccauacauggaacggggacugagauacgaugaggccugcgaaagggcggaguaucaccauagccaauuacacaaagugggcgaggguaaucgcaaguaccugcccccucuauauaaaucgcgagacaaggacgggcggaugguguucaacgaugaacucggcgacaucccacguaaucccgucguucugagaucucuuaaccaggccaggaagguguugaacgcucugauagcacgcuacggauccccgucaaguguacacauugagauggcccgggaacucagcaaaccuuuugaugagagaaugaaggugggcaaagaacaggaggcuuauagggagcgaaaugaaaaggacaaacagacguucgucgccgaguuugggaucgugggagcagcgaaggguggcgaguucgaaaaauggaagcuguaccgcgaacaacaggggaagugugccuauuccauucagggaaucgauuuaaaccggcugcuugagcccggcuacguugagaucgaccaugcuuugccauacucuaggagcuuugaugacucaaaaaguaauaaggugcucguccuggccgcagaaaacagaaauaaagguaaccguacuccuuaugaguaccuagauggggaacacaauuccgagcgcuggcggcaguucgugggcuuuguagaaagcaacaagcuguauagacaagcuaaaaggucucgacuccugcggaaggacuucggaaaggagcaggccgaugaguuucgcgaaagaaaucuuaacgacacaagguacguuugccgguucuuuaaaaaucagguggagcaguucuugaagcuggcagaaggcucagagaguaaacgaugugucguguuaagcgggcaacucaccgccuuccugagagcucgcuggggacuuauuaaggucagggaugaguccgaccgucaucacgcgcuggacgccgugguuguggcagcuugcacucaugguaugguaaaacggaugucugauuaugccagaaggaaggaauuggaccaggucgccgagggcuuuguggauguugaaacaggggagauaaucaacgcugcaauguuccagcagcuccacgaacacuuucccgacccauggccccauuuccgcgaugaggugcaaaugcgacugaagauugacgauccugcccagcuaagaucggaccugcuccggcugggaaauuacgcggaggaagauguccacgcugugaggccacuuuuuguaagccgcgccccgcagcguagaaacuccggcgcagcccauaaagagaccaucuauggucaacccgaacgguugaaggcucaagggggcgugacggagaaaguugcacugaccgccuuaacaaugaaggaccucgauaggcugauagacccucaccgcaaugaaaaacuuuacgcggcuauucgaaagagacuggaggaguucggaggcaaggccgauaaagcauuugccgcuucaaacccacuacacaagcccgacaaagaagggaacccuacuggaccaaucguccggaccgugacacucgagaucgacaagcugaguggcgugcccgucaggggugggauugccaaaaaugauacuauguugcgcguugacguguucaccaaggcaggaaaauuucaucuggugccgguauacguccaccauaaggugacaggcuuaccuaacagagcuaucguugccucuaaggaugaagacgaguggaccgcgauugaugacagcuucgaauuucucuucucccuguauccaaaugaucuugugacuauaacgcagaaagguaaggcccccgucaggggcuacuaugcaucaugucaccgggggacaggagcuuuuagccugugggcccaugaccgugcuucuuccgugggcaaagggggacagaucgagggcauugguaucaagaccgcauuggccguucagaaauacaacguggauguacucgggacuaccuaugccgcuccucuggagcagcgccgaggacuagcguga

SEQ ID NO: 2776 - RNA, 3363 nt, Artificial Sequence
  Cas9 variant
augagaaaggugaccaucggcuucgacauuggggucagcuccguuggauggucugugguagauaugaacaauggugccauaguggagacaggcgucaggcuguuuucagcuaguagcgcagaaaacaauguggagcggcgcaacaaucgacagacucguagacucaacaggcggcgcaaaaauagacuuaaggacguuaaauaccuguuggaaacgaaccacuucaccuuugaucaagagcaggggacaaaucccuaugaauuaaggguggccggacugcaucggaagcuaacucgcuccgagcucgcgcgagcucuguaccaccuugucaaaagaaggggcaucucuuaugaccugaccgauauugaggaagaggaaaucgugacaaccucggccuacaagacugcauuggguaagaaccagucacagcucgccgagaaaacaccuggggagauucaauucgcucggcuggaaaauuauggaaagguacguggcagcaucgagauaaacgaacaggacauccugcucaauauuuuuccaaccagugcauacuuaaacgaggccaaacgcauccuggcuacgcagagaaaguucuauccggaaauuacugaggccuuuaucgagaaauacugcaccauacuuacaaggaagcgggaauacuauguuggccccgggacugagaagaaucgaaccgauuacggaauuuaucgcacaaacggugaaaccuuggacaaccuguucgagauccuaauuggcaaagauaaguuuuacccuaaugaagagagagcggcagggaacuccuauacggcccaacucuucaauuuugugaacgaccugaauaaccuuaaaauccagacuaucgaggaucagaagcugacaccaaaacagaaggaagagauuauagaacaggucaaaaccgcugagaagaaggugucuuugauccaacucauuagcaaaaucacuaagacacccaaagaccagauaaccggauacaggacggauaagaauggcaaaccugaccugcauuccauggccguguuccggaagguccgcaagcaguuuuuaaccauggaaauugacauccugcacuggccagaugagcuccuuaacgaccuggguagauugcuaacacugaauacugagaaaggggaaaucaggaagcaacucaccaaagauuucaugaagcguuaucccauucugaacgagcagcuuguugaccagaucauugaaaaucggcauauauucgcagugucaggaaaccacaaauggcaccgauuuagucugagaacaaugaaugaguugcucccugagaugcuggcuacuagcaaggaacagaugaccuuacugucugagaggggcaugaucaagcaacauaaacgcgauuaccuaaagaugaacgaacucgacgcccggcugauuuccgaggaaaucuacaauccaguagugggcaaaucagucagagaggcgaucaaacuuuucaacgaguugaugaaaaaguaucaggaagugagguacguugugcuggagaugccgcgcgaugacaacgaagagaaggccaaaaaggaacuccagaaauaucagaaggagaaugagaacgaaaaagagauugcacugagcgaauuucaacgaaagggguucuuuagugaugcucagcuugagcgggcccugauaaaagaccguaaguugaagacaaaaaucagauucuggcaccagcaggaaggaaagugucucuacucuggucaaauuaucacccccgucgagcuguuaacuaauuccuuuagcuucgauauugaccauaucauaccucagucggugucuuuugacgauucccugaacaauaaaguacuaugcacgaaggagaugaacgaccagaaaggcaagcagacaccauauggguuccuccugaauggaaacggccaagguuuugauagguucaaggcuaugguuaaugccaaccgccuuaugucaaaagggaagaaaaagaauuugcuguuuauggaagaccucaacaauaucgagacccggaaaagauucauugcaaggaaccugguggauacucgauacgccagucgcgucguguuaaaugaaauccagcaguaucugcgggcuaagaacaaggacacccaagucgcggugguuagaggcaaauucacagcaacccuuaggaagcacuggaacauuaauaaaagccgugagacucaccaucaccaugccuuggaugcuuccaucauagccauuacaccccuccugucuguguggaagaaaaagcagacgcuaaucccuaagacccugagcgaggaaaaacucgaguuugaauacgacgauauuguagaggacacuaucuucgaaaaggcacuguaccagcuuccaaaagagaacuuuaaggagcaguugaauaacucacaacccaauauaaaauucaguuaucaggucgauaagaaaaugaaccgcaagguguccgacgccacaaucuacagcguuaagcaggcuaaacugucuucagauaagcagagugaagaguauguguuagccaaaauuaaggacaucuacagcgucgaaggauauaaaaccuuugcaaagauuuacgagaaggacaaauccaaguuccucauggcgcaaaaugauccgaaaacauuugaaaagcuggaggagaucauacagucuuauccuucgacucgggaaauuaucgugggcgagaaaguaaaggugguugacgucagccccuucgaacuuuacagaaaggaguacggguauaucaccaaauacgcuaagaaaaacaauggaccaauuaucaggcagcugaaguauuacgaucacaaaauugguaugcauuuggacauaacgaaccagaagaauaacggcaaggggaaaaaggugauccuccaacagcugaaauccuggcgaaccgauguguauuacaaucacgaaaagcaggaguaugagauuaugggacuaaaauacucagaccugcgguuuaagaaggaucaauacggcaucccuaaagaacgcuaucaggaggucaagcagauggaaaagauugcaccccagagugaguucuguuuuucucucuacagaaacgacaggaucaagguucugaauaaagagacagaugaagagguggaacuuuuguucggugcccggaacuauacuagcgccggguacguggaccugaagccaauagaucgaguagaguuuggcaaaaaggaauggauccccgucuaucaauacgcuaccuccgacggaaagugcaaaaagaaauucgccaagaaaggcuaugagauuuacaaggugaacacaacuaucuuaggggagucauacuauauuaagaaagaaagaaugcucccuaagaauauccuggauuga

SEQ ID NO: 2777 - RNA, 3363 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauuugguaaggcggacaaaccgccaaggacgacguuuaacuagaaggaagaaacaucggcgcgugagacugaauaggcuauuugaggaaauuggccucaucacggacuucaccaagauaucaaucaaccugaauccuuaccagcuucgggucaaaggucugacagaugaguugaguaacgaagaacucuuuauugcccugaagaauauggugaagcaccgcgggaucagcuaucuggacgaugcguccgacgauggaaacucuucgguuggcgacuacgcucagauugugaaagaaaauucaaagcagcucgaaacuaaaaccccaggccaaauccaguuagagcgauaucagacauacgggcagcugagaggagauuucaccgucgaaaaggacgguaaaaagcauaggcuuauaaacguguuuccgacuagcgccuaucggagugaggcauugcguauucugcaaacacagcaggaguucaauccccagaucaccgaugaauuuauuaaccgcuaccuagagauccucacgggcaagagaaaauauuaccacgggccuggaaaugaaaaguccaggacugacuacggccgguaucgaaccucuggugagacacuggauaacaucuucgggauucuuauaggaaaaugcacuuuuuacccagacgaguuccgcgccgcuaaggcaagcuauaccgcccaagaguuuaaccuguugaaugaccucaacaaucugacaguacccaccgagacgaaaaaguuauccaaagaacagaagaaccagaucauuaauuacguuaagaacgagaaagcuaugggcccugccaagcuguucaaauauaucgcgaagcuccuuucaugugauguggcagacauaaaaggcuacagaauugauaagagugggaaggccgaaauccauacuuuugaggcuuauaggaaaaugaagacacuggaaaccuuggacaucgagcaaauggaucgggagacucuagacaaacuggccuacguccucacacugaauaccgaacgcgagggaauccaggaagcacuugagcacgaguucgcugaugguagcuucucucagaaacagguggacgagcuggugcaauuuagaaaagccaacuccucaauuuucggcaagggguggcacaauuuuagcgucaaguugaugauggagcucauuccagaacuguacgagacgagugaagaacagaugaccauauuaacaaggcugggaaaacagaagacuaccucuuccagcaacaaaacaaaguauaucgaugagaaacuacucacugaagagauuuacaaucccguuguggcgaagucgguacgucaggccaucaagaucgugaacgcagcuauuaaagaauauggcgacuucgauaauauagucaucgagauggcccgggaaaccaacgaggacgacgagaagaaagcuauucaaaagauccagaaagccaauaaggaugaaaaagacgcagccaugcugaaggcugcgaaccaguacaacgguaaggcagagcuuccucauucuguguuucacgggcauaaacaguuggccacaaagauucgacuguggcaccaacagggcgaaagaugccucuauaccggaaaaacuaucuccauacacgaucugaucaauaacccaaaucaguucgagguugaccauauucuuccgcugucaaucacguuugaugacaguuuggcuaacaaggugcucgucuacgccacagcaaaucaggaaaaaggccaaaggacccccuaucaggcccuggauagcauggacgaugcuugguccuuccgcgaguuaaaggccuuugugcgggagucuaagacucugagcaacaaaaagaaagaauaccuacucaccgaggaagacauuucaaaguucgauguaagaaagaaguuuaucgagaggaaucugguugacacacgcuacgcaagucgagugguccuuaacgcguugcaggaacacuuccgggcucauaagauagauaccaaaguguccgucgugcgugggcaauuuacuagccagcugagaaggcacuggggaauugagaagacacgcgacacguaucaucaccacgccguugacgcacucaucauugccgcuucuucacagcugaauuuauggaaaaagcagaaaaacacccuggugaguuacagcgaggaucaacuuuuggacaucgaaacuggugagcucauauccgaugacgaauauaaggagucuguauucaaggccccuuaccagcauuucgucgauacacugaaaucgaaggaguuugaagacagcauccuauucuccuaucagguggauucaaaauuuaaucggaagauuagugacgcaaccaucuacgcuacaagacaggccaaaguuggcaaggauaaagcggacgagacuuaugugcuggggaagauuaaggauaucuacacccaagacggauacgaugccuucaugaaaauauauaagaaagacaagucuaaauuucucauguacaggcacgacccacagacguucgaaaaggucauugagcccauccuggaaaacuauccuaauaagcagaugaacgagaaaggcaaggaggugccauguaaucccuuucuuaaauacaaggaggagcaugguuauauccgaaaauacagcaagaaggggaacggcccggaaauuaaauccuugaaguauuacgauucaaaacugggaaaccacaucgacauuaccccuaaggauagcaauaacaaaguaguguuacagucucucaagcccuggcgcacagacguuuacuucaauaagaacacuggcaaauaugagauacuggggcuuaaguacuccgauaugcaauuugaaaaaggaaccgguaaguauaguaucagcaaagagcaguacgagaauauuaagguccgggaaggcguggacgagaacucugaguucaaguuuacacuguauaaaaaugauuugcuccugcuaaaggacuccgaaaacggggaacagauccugcucagauucacuucaaggaaugauaccaguaaacacuacguggagcugaagccauauaaccgucaaaaauuugagggaagcgaauaccuuauuaagucguugggcacggucguuaaaggugggcgcugcaucaagggccugggaaaguccaauauaucuaucuacaaagugcggacagacguguuaggcaaccagcauauuaucaagaaugagggggauaaaccuaagcucgacuucuga

SEQ ID NO: 2778 - RNA, 3363 nt, Artificial Sequence
  Cas9 variant
augggccuggacaucgggguggccagcgucggauucuccguucucgauauugacaaggguaaagugauagagcuuggcgcuagacuguuuucugcaaccguagccgcggggaaccaggauaggcgggacaugcgcggagcucgacguuuguuaaauagaaacaagcaaaggcggcaggauacaggcaaacuguucaagaaauuuggucuaaucgacgauuucgacaaggggucauuuuacgauaauuucaaccagaaucucaaccccuaugaacugcgcgugaagggacuuacugagcagcugacgaaagaagaguuggccgaaagucucuaccaaauugucaagcacagaggcaucagcuaugcacugaaagacgccgauguggacgagggcgggaccgauuacuccguuucucugaagauuaauucgcaggagcucgcugagaaaacuccugcacagauccaguuacaaaggcugaacgacuauggaaaggugcggggucaggucgugauaggcgacgauccagacaaucagaagguacuuuugaacguuuuuccgacaucagccuacgagaaagaagcuaagcagaucauugccacccaacagcaguucuaucccgagagccugacagauaaauuuaccgaggaauacugccaaauccuaacucgcaagcgagacuacuucguggggccuggaaaugagaaaaguagaacagauuauggcauuuacaagaccgacgguaggacgcucgauaaccuguuugaagaacuuaucgggcaugacaaaauauauccagaagaacugcgggcguccgcagccucuuacacugcucaguuguucaauguccucaacgaucugaauaacuuacguauucugaacuaugaggacggaaagcucaccaaggaagauaaagagaagaucauugccgaaaucaaaaauaacacaacuaccaucaauaugcuuaacgugauuaagaaaguggcaggcuguagcaaggacgacauaaagggcuuucgcgucaaugagaaagauaagcccgaaaucuccucaaugccuguuuacagaaaaauucacaaggaccuguugaaagcugggguggauaucagugacuggccaguagaguucauagaugagcuuagcuucauucugacacucaacaccgaaaauggagagaucaggaagcagcugaacaaucggcuugcccccaaguuugacuuccugaacgcggauuugauccagcucauuaucgacaauaaagauucuuuugaaauuaagacgaacaauaaauggcaucgauucuccgugaagacuaugaacaaacugauaccugagaugauggaacgcccagucgagcaaaugacauuacugaaugagaugggucuagugaagaaggacaaaaagagauuugaaaacaacaaauaucucccguacaaggagaucgccaaagauauuuucaaucccguugcaucaaagagcgugagggaagcucugaaaaucgucaacgccgugcuuaagaaguacggccacaucgacuauuugguaguugagaugccucgggauaaaaaucugaaggaggaacaggacaacauuaaagaguuucagaauaagaacaaaaaggcuaaggacgccgcauucgaagccuuugugaaaagugucgggucugagcagcgcgugaaggaagcucucuccaaaaauagaaagcugcaaaugaaaaugaggcuuugguaccagcagcaggagauagauccauauaacggaaagaccaucgacgcgacugaucugauuaauaaccccgacaaguucgagaucgaucauauuaucccucaaagcauaucguuuuacgacucuaucaauaacaaaacauugugcuucgcauccaugaaucaggucaagggccagaaaaccccauaugaauuuaugcucgagggucacgggcagucauacgauaaguucaaagccacggugauggcuaacaagaauuucggcaaggccaaacgugcaaacuaucuguuugaagagaacguuagugacauugaaacccggaagcgauucuuaagcagaaaucugguggauacaagguacuccucucgcguaguccuaaacagccuccaagacuuuuuccgggagaaaucagccgauacuaaggugaccguuaucagaggaaaauuuacaaguaauaugaggaagcacuggcauauugacaaaacucgcgagaccuuccaccaucacgcuaucgaugccuccauaauugcagcgacacccuuucugcgaauguggaagaagggcgggaccaucuucccggugaaagucggagaagagagcauugacaucgaaacuggugagauacuugacgauaagaacuuugacaaagcuauguacgaggagccuuauucuggcuucgugucagagaucaugaaugccgaugaccggauuaaguuuagucaccagguagauaaaaagaugaaccguaaggugagcgacgcaacgaucuacuccacaagaaccgggaaauuggccaaggauaaaaaggacgcugaauauauuguugccaaagucaaggauaucuacucuguggacggauucaagaaauuuaagaaaguguaugauaaggacaaaacuaaguuccugcucuacaaguaugaccccaggaccuucucgaaacuggagcgcauaauuagcgauuguccagacaaggucgaaaaaguucagacaaauggcaaggugaaagcaguggauaucuccccuuuugagauguaccggagagaccaugguaugaucaagaaguacaguaaaaaggggaacggccccgcuauuaaacaauuaaaguaucuggauaaaaagcuaggaucacacaucgacauuaccccagccaaugcgaacggcaaacauguaauauugcagucucucaagcccuggaggacugaugucuaccugaaucacgagacaggggaauaugagaucaugggaauuaaguacagcgaccuaaaauucaacaagaaugaagguuauggcaucaaaaaggauaaauaccuggagauuaagaagguggaagagguuuccgagaaaucagaauuuauguucagccucuaucgaaaggaccgcgugaaaguccaggauaugaagacgggggagucuguggaacuguuguuuuggucccggaacuucaguaauaaaaaguacgccgagcuuaagccuaucagccaggcugaaaacgacaaaaagcugccaguuuacggaaaaggcagauuaauaaagaggcucaucccgaaaaacugcaagauuuggaaggugaauaccacuauccugggugaucccuauuaccuugagaaagagucugacuccccuaaggacauucuggauuga

SEQ ID NO: 2779 - RNA, 3366 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauuugguaaggcggacaaaccgccaaggacgacguuuaacuagaaggaagaaacaucggcgcgugagacugaauaggcuauuugaggaaucaggccucauuacggacuucaccaagaucaguauaaaccugaauccuuaccagcuucgggucaaaggucugacagaugaguugagcaacgaagaacucuuuaucgcccugaagaauauggugaagcaccgcgggauuuccuaucuggacgaugcgucugacgauggaaacucgucaaucggcgacuacgcucagauuguuaaagagaauagcaagcagcucgaaacuaaaaccccaggccaaauccaguuagagcgauaucagacauacgggcagcugagaggagauuucaccguggaaaaggacgguaaaaagcauaggcuuauaaacgucuuuccgacaagugccuaucgguccgaggcauugcguauucugcaaacucagcaggaguucaauccccagaucaccgaugaauuugugaaccgcuaccuagagauucucacgggcaagagaaaauauuaccacgggccuggaaaugaaaagucuaggacugacuacggccgguaucgaaccaacggugagacacuggauaacaucuucgggauccuuauuggaaaaugcacuuuuuacccagacgaguuccgcgccgcuaaggcaagcuauaccgcccaagaguuuaaucuguugaacgaccucaauaaccugacaguacccaccgagacgaaaaaguuauccaaagaacagaagaaucagauaaucaacuacguuaagaaugagaaagcuaugggcccugccaagcuguucaaauauauugcgaagcuccuuucaugugauguggcagacaucaaaggcuacagaauagauaagagugggaaggccgaaauucauacuuuugaggcuuauaggaaaaugaagacacuggaaaccuuggacaucgagcaaauggaucgggagacucuagacaaacuggccuacguccucacacugaacaccgaacgcgagggaauccaggaagcacuugagcacgaguucgcugaugguagcuucucucagaaacagguggacgagcuggugcaauuuagaaaagccaauuccucaauuuucggcaagggguggcacaacuuuagcgucaaguugaugauggagcucaucccagaacuguacgagacgagugaagaacagaugaccauuuuaacaaggcugggaaaacagaagacuaccucuuccagcaauaaaacaaaguauauagaugagaaacuacucacugaagagaucuacaaccccguuguggcgaagucgguacgucaggccauuaagaucgugaaugcagcuaucaaagaauauggcgacuucgauaacauugucauagagauggcccgggaaaccaaugaggacgacgagaagaaagcuauccaaaagauucagaaagccaacaaggaugaaaaagacgcagccaugcugaaggcugcgaaccaguacaaugguaaggcagagcuuccucauucuguguuucacgggcauaaacaguuggccacaaagauccgacuguggcaccaacagggcgaaagaugccucuauaccggaaaaacuauuuccauccacgaucugauaaacaauucaaaccaguucgagguugaccauauccuuccacugaguauuacguuugaugacagcuuggcuaauaaggugcucgucuacgccacagcaaaccaggaaaaaggccaaaggaccccguaucaggcccuggauuccauggacgaugcuuggucuuuccgcgaguuaaaggccuuugugcgggagagcaagacucugucaaauaaaaagaaagaauaccuacucaccgaggaagacaucaguaaguucgauguaagaaagaaguuuauugagaggaaccugguugacacacgcuacgcaucccgagugguccuuaaugcguugcaggaacacuuccgggcucauaagaucgauaccaaagugagcgucgugcgugggcaauuuacuucucagcugagaaggcacuggggaauagagaagacacgcgacacguaucaucaccacgccguugacgcacucauuaucgccgcuucaagucagcugaacuuauggaaaaagcagaaaaauacccuggugagcuacuccgaggaucaacuuuuggacauugaaacuggugagcucaucucugaugacgaauauaaggaguucguauucaaggcccccuaccagcauuuugucgauacacugaaaucgaaggaguucgaagacagcauacuauuuuccuaucagguggauucaaaauucaaccggaagaucagugacgcaaccauuuacgcuacaagacaggccaaaguuggcaaggauaaagcggacgagacuuaugugcuggggaagaucaaggauauuuacacccaagacggauacgaugccuuuaugaaaaucuauaagaaagacaagucuaaauuccucauguacaggcacgacccucagacguuugaaaaggucauagagccaauucuggaaaauuaucccaacaagcagaugaaugagaaaggcaaggaggugccuuguaacccauuccuuaaauacaaggaggagcaugguuauauccgaaaauacagcaagaaggggaacggccccgaaaucaaauccuugaaguauuacgauucaaaacugggaaaucacauugacaucaccccgaaggauagcaacaauaaaguaguguuacagucuguuuccccuuggcgcgcugacgucuacuuuaacaauacaacuggcaaguaugagauucucgggcugaaguacgcagaucuucaauucgaaaaaggaaccgguacauauaagauaagucaggagaaauacaacgacaucaagaaaaaggagggcguggauagcgacucugaauuuaaguucacucuguauaaaaaugauuugcuccuggugaaggagaccgaaacgaaagagcagcaacuauuucgguuccuguccagaacaaugcccaagcagaaacacuacgucgaacucaagccauaugacaaacagaaguucgaagggggagaggcccugauuaagguucuuggcaacguggcuaauggugggcagugcaucaaaggcuugggaaagucaaacauuaguaucuacaaagugaggaccgauguacugggcaaucaacauauaaucaagaacgaaggggacaaaccuaaguuagacuuuuga

SEQ ID NO: 2780 - RNA, 3366 nt, Artificial Sequence
  Cas9 variant
augaacggccuggugcucgggcuugacaucggaauugccagcgucgguguuggcauacuggagaaaaauuccgggaaaaucauucacgcuaacucuagauuguuccccgcagccaccgcggauaauaacguggaaaggcggaagaaucgccaggcucgacguuuaaacagaaggaaaaagcaucggggaguacgcuuucaagaccuguucgaggauuacggccuacucacagacuuuucaaaagugaguaucaaucugaacccuuauagacuuagggucgauggucugaauaagcaguugacuaacgaagaacucuucauugcccugaagaauaucgugaaacggcgcgggauaagcuaccuggacgaugcauccgaagacggaggcacgguuucuucggauuauggcaaggccguggaggagaaccgaaaacucuuagcugaacagaccccagggcagauccaacuggagagauuugaaaaguacggacagcuuaggggugacuucacagucguggagaauggcgagaaaugccgguugauuaacguauuuucaacuagcgcauauaagaaggaagccgagcguauccugcgcaaacagcaggaguucaauaguaagauuaccgaugaguuuaucgaagacuaccuaaaaauacucacagggaagagaaaauauuaccacggaccgggcaacgagaaguccaggaccgauuacggucgguuccgaaaagacgggacuacacuggacaacauuuuuggaauccuuauuggcaaguguaccuucuaucccaaugaguaccgcgcuucuaaggccagcuauacggcgcaagaauuuaaccuguugaaugaucucaacaaucuguccguuccuacugagaccaaaaaguuaucagaggaacagaaaaagacaaucaucgaauacgcaaaaagugccaagacucugggcgcuagcacccuccuuaaguauauugccaaaaugauagacacaucuguggaucagaucagaggguacagggucgacgugaacaauaagccagagaugcauaccuucgagguguaucggaaaaugcagucccuggaaacgauuucagucggagaguugagccgcaacguucuagaugaacuggcacacauccucacucugaauacagagagagaagguauagaggaggcuauuaacaccaaacuuaaggacaguuucucucaagaucaggugcuggaauugguacaguuuaggaagaauaacuccagccucuucucgaagggcuggcauaauuuuucucugaaauuaaugauggagcugauccccgaacuauacgagacuuccgaggaacaaaugacaauccucacccgucuggggaagcagaaaucaaaggagacgaguaaacggagcaaguacauugacgaaaaggagcuuaccgaagagaucuauaacccuguggucgccaaauccgugcgacaggcgauuaagauaaucaaugaggccacaaagaaguacggaauuuucgauaacaucguuaucgaaauggcaagagagaacgacgaagaggaugcuaaaaaggacuauauuaaaaggcagaaggccaaucaagacgaaaagaacgcugccauggagaaagcagccuuucaguacaauggcaagaaagaguugccagauaacauauuccacggucacaaggaacuggcuacuaaaauccgccucuggcaucagcagggggagaagugccuguauaccggcaagacaauucccaucucugaccuuauucacaaucaauacaaauaugaaaucgaucaugugcugccuuugagccucucauuugacgauagucuguccaacaaggucuuagugcuggcgacugcaaaucaggagaaaggacagcggaccccauuccaggcccuagacagcauggaugacggcuggucuuacagagaauuuaagucauacguaaaagagaguaagcuccuggggaacaagaaaaaggaguaucuuuugacagaagaggauauaagcaaaaucgaaguuaagcaaaaauucauugagaggaaucugguggacaaccgcuacuccucucgagucgugcucaaugcucugcaggauuuuuauaaggcccacaaguucgacaccacuaucucggucgugcggggacaguuuacgagccaguuacguagaaaauggggucuggagaaguccagggaaacauaccaccaucacgcaguugaugcccuuauuaucgcugccucaagucaauugcgccucuggaaaaagcauaacaauccgcugauaucuuauaaagagggccgguucauugacagcgaaaccggggagaucauuucccuaucagacgaugaauacaaggagcugguguucaaagcacccuaugaccacuuuguagauacucucagaagcaagaccuucgaggacucuauccuguuuuccuaccaggucgauaguaaguacaacaggaaaauaagcgacgcgacaaucuaugcuacccgaaaggccaaacuugauaaggacaaaucugaagagacuuacguguugggaaagauuaaggauaucuauucccaggcaggcuacgacgccuucauuaaaaucuauaauaaggauaaaucaaaguuucugauguaccauaaagacccucaaacauucgaaaagguuauagaggaaauuuuacgcacguauccaaguaaggagcucaacgauaaaaacaaggagauccccuguaauccuuuugaaaaauaccggcaggagaacgguccaaucagaaaguacagcaaaaaggggaauggccccgaaauuaagucgaugaaauauuacgacaagaacaucccggaguccuucauuaauauaaccccuucuaacagcaauaacaaagugcugcuuaggcagcuguaucccuggcguacugacgucuacuuuaauccacagacagauaaguaugaauugcucggacugaaauacgcugaccuacaauucgagaaggccaccggcaaguauucaaucacaauugauaaauacaacgagaucaaggaaaaagagggggugaguaaggaauccgaguuuaaauucacucuguacaagaaugaccuccugcuuauuaaagauaccaagaacaaugaggaacagaucuuucgcuucuugucucggacgaugccuaaccagaaucacuauguagagcugaagcccuacgacaaaggaaacuucgaagguaaggagaaaauaaagguguuuaaaaugaccagcaacggcagaugcaucaagggguuaggaaagaaauaucucuccauuuacaagguuaaaacagauauccugggcaauaagcacuucauuaaaaaggaaggugacgagccaaaacuuaaguuuuga

SEQ ID NO: 2781 - RNA, 3366 nt, Artificial Sequence
  Cas9 variant
augaacggccuggugcucgggcuugacaucggaauugccagcgucgguguuggcauacuggagaaaaauuccgggaaaaucauucacgcuaacucuagauuguuccccgcagccaccgcggauaauaacguggaaaggcggaagaaucgccaggcucgacguuuaaacagaaggaaaaagcaucggggaguacgcuuucaagaccuguucgaggauuacggccuacucacagacuuuucaaaagugaguaucaaucugaacccuuauagacuuagggucgauggucugaaucagcaguugacuaacgaagaacucuucauugcccugaagaauaucgugaagcggcgcgggauaagcuaccuggacgaugcauccgaagacggaggcgccguuucuucggauuauggcaaagcuguggaggagaaccgaaagcucuuagcagaacagacgccagggcaaauccagcuggagagauuugaaaaauacggacaggucaggggugacuucaccgugguagagaauggcgagaagcggcgucuuauuaacguuuucucaacaagcgccuaucgcaaagaagcugagaagaucuugagaaagcagcaagaauuuaauaaccagauuacugaugaguuuaucgaagacuaccugaaaauacuaaccgggaagaggaaauauuaccacggaccgggcaacgagaagagucggacagauuacggucgauuccgcaccgacgggacuacacucgacaauauuuuuggagugcugaucggcaaaugcaccuucuaucccaacgaguacagagccuccaagucuagcuauacggcgcaggaauuuaaucuucugaacgauuugaauaaccucacugucccuaccgagacaaagaagcuguccgaggagcagaagaaagugauuguggaauacgcaaaggaggccaaaacuuuaggcgcuucaacccugcucaaguauaucgucaaaaugaucgacgccaguguugaucaaauuagcggguacaggguggacguaaauaacaagccagagaugcauacauucgaaguguaucggaagaugcagucucuugagaccauauccgucggagaacugucacgcaauguguuggaugagcuagcacacauccugacgcucaacacugaaagagaggguauugaggaagcuaucaauagcaaacugaugggcguuuucagucaggaccaagugcuugagcugguccaguuuaggaagaacaauucuuccuuguucagcaaaggguggcauaacuuuucgcucaagcugaugauggaauuaauacccgagcuguacgagacaucugaggaacagaugaccauucuaacucgucucggaaaacagaaguccaaggaaacaucaaaacggaccaaguacaucgaugagaaagaacugacggaggagaucuauaauccugugguagccaagaguguucgacaagcgauuaaaaucauuaacgaagccaccaagaagcacggcauauucgacaacaucgugauugagauggcaagagaaaauaacgaggaagaugcuaaaaaggacuacaucaaaaggcagaaggccaaucaggaugagaaaaacgcugccauggagaaggcagccuuucaguauaaugguaaaaaggaacuuccagggaacaucuucaauggccacaaggaguuggcuacaaaaauucgccuguggcaucaacagggagaaaagugucucuacacuggcaaaaccauacccaucagcgaccugauucacaaccaguauaaguacgagaucgaccauauucuuccucuguccuugucuuuugaugacagccucucaaauaaaguccuggugcacgcgacagcaaaccaggaaaaggggcaacggacuccauuccaggccuuagauaguauggacgaugcuugguccuauagagaguuuaagagcuacgucaaagaccugaagucucuaucaaauaaaaagaaagauuaccuccugaccgaggaagacaucaguaagauagaggugaagcagaaauucaucgaaaggaaccuuguugauacacgcuauagcucccgagugguauugaaugcccugcaggacuuuuacaagucucaccaauucgauaccacuauuucggucgugcggggacaguuuacgagccagcuccguagaaaauggggucuggagaaguccagggagacauaucaucaccaugcaguugacgccuuaaucauugcugccucaagucaacugcgccuuuggaaaaagcagaacaauccguugaucaccuacaaggaaggccaguucauagauucucagacuggggagauuaucagccucaccgacgacgaauauaaagagcugguguucaaggcacccuacgaucacuuugucgacacacuacauuccaaaaccuucgaagauggcauucuguuuucauaucaaguggacagcaaguacaaccggaaaaucucugaugcgacuauauacgcuacaagaaaggccaaacucgacaaggauaaguccgaggagacguauguacugggaaaaaucaaggacauuuacagucaggcagguuaugaugccuucaucaaaauuuacaacaaggacaaaaggaaguuucuuauguaucacaaggauccucagaccuucgaaaaagugaucgaggaaauauugcgaacuuacccaagcaaggagcgcaaugacaaaaacaaggaaguucccugcaauccuuuugagaaauaucggcaggagaacgggccaauuagaaaguacucuaagaaaggcaauggacccgaaaucaagugucugaaauacuaugauaacaaguuaggcaauuacaucgacauuuccccggacgggucagauaaccaagucgugcuccagagucugaaaccuuggaggacagacguguauuucaaucaccagaccaagaaguacgagcuuaugggacugaaauauagcgauuugucguuugaaaaggguuccggcaaauacucuaucagcaacgagaaguauaauucaauuaaacguauagaaggggucaacgagcagagugaguucaaguuuacacucuacaagaaugaccugauccuaauuaaagauuccgaaaacaaugagcaaaagcuguuccgcuuuaacucucggaacgacacugcuaaacauuacguugaacucaagcccuaugauaaagccagauucgacggacagcaggagcugaucaccauucuuggcaauguggcaaagggugggcaaugcuugaaaggccugaacaagagcaauaucuccauauucaaggugaaaacggauguauuaggaaagaaacacaucauuaagaaagagggcgacgaaccaaagcucaaguuuuga

SEQ ID NO: 2782 - RNA, 3366 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauuugguaaggcggacaaaccgccaaggacgacguuuaacuagaaggaagaaacaucggauugugcgccugaauagacuauuugaggaaucaggccucaucacggacuucaccaagauaaguaucaaccugaauccuuaccagcuuagggucaaaggucugacagaugaguugagcaacgaagaacucuuuauugcccugaagaauauggugaagcaccgggggaucuccuaucuggacgaugcgucugacgauggaaacucgucaguuggcgacuacgcucagauugugaaagagaauagcaagcagcucgaaacuaaaaccccaggccaaauccaguuagagcgcuaucagacauacgggcagcugcgaggagauuucaccgucgaaaaggacgguaaaaagcauagacuuauaaacguguuuccgacaagugccuauagguccgaggcauugcggauucugaagacucaacaggaguucaauccccagaucaccgaugaauuuauuaaccguuaccuagagauccucacgggcaaacgcaaguauuaccacgggccuggaaaugaaaaaucuagaacugacuacggcagguaucggaccaacggugagacacuggauaacaucuucgggauucuuauaggaaagugcacuuuuuacccagaagaguuccgagccgcuaaagcaagcuauaccgcccaggaguuuaaucuguugaacgaccucaauaaccugacaguacccaccgaaacgaagaaauuauccaaggagcaaaagaaucagaucauuaacuacguuaaaaaugaaaaggcuaugggcccugccaaacuguucaaguauaucgcgaaacuccuuucaugugacguggcagauauaaagggcuaccgcauugacaagagugggaaagccgagauccauacuuuugaggcuuauagaaagaugaaaacacuggagaccuuggauaucgagcagauggacagggaaacucuagauaagcuggccuacguccucacacugaacaccgagcgggaagggauucaagaggcacuugaacacgaguucgcugacgguagcuucucucagaaacagguggaugagcuggugcaguuucgcaaggccaauuccucaaucuucggcaagggguggcacaacuuuagcgucaaauugaugauggaacucauuccagagcuguacgaaacgagugaggagcaaaugaccauauuaacaagacugggaaagcagaaaacuaccucuuccagcaauaagacaaaauauaucgacgaaaagcuacucacugaggaaauuuacaaccccguuguggcgaagucgguaaggcaggccaucaaaaucgugaaugcagcuauuaaggaguauggcgauuucgacaacauagucaucgaaauggcccgugagaccaaugaggaugacgagaaaaaggcuauucagaaaauccaaaaggccaacaaagacgaaaaggaugcagccaugcugaaggcugcgaaccaguacaaugguaaagcagaacuuccucauucuguguuucacgggcauaagcaguuggccacaaaaauucggcuguggcaccagcaaggcgagcgaugccucuauaccggaaagacuaucuccauacacgaccugaucaacaauccaaaccaguucgaaguugaucauauucuuccgcugucaaucacguuugacgauaguuuggcuaauaaagugcucgucuacgccacagcaaaccaggagaagggccagagaacccccuaucaagcccuggacagcauggaugacgcuugguccuucagggaguuaaaggccuuugugcgcgaaucuaaaacucugagcaauaagaaaaaggaguaccuacucaccgaagaggauauuucaaaauucgacguacagaagaaguuuaucgaacggaaccugguugauacaagauacgcaaguagggugguccuuaaugcguugcaggagcacuuccgcgcucauaaaauagacaccaagguguccgucgugcgagggcaauuuacuagccagcugcggcgucacuggggaauugagaaaacaagagauacguaucaucaccacgccguugacgcacucaucauugccgcuucuucacagcugaacuuauggaagaaacagaagaauacccuggugaguuacagcgaagaccaacuuuuggauaucgagacuggugaacucauauccgacgaugaguauaaggagucuguauucaaagccccuuaccagcauuucgucgacacacugaagucgaaagaauuugaggauagcauccuauucuccuaucagguggacucaaaguuuaacaggaaaauuagugaugcaaccaucuacgcuacacgccaggccaagguuggcaaagacaagaaggaugaaacuuaugugcuggggaaaauuaaggacaucuacacccaagauggauacgacgcguucaugaaaauauauaagaaagauaagucuaaguuucucauguaccggcacgacccacagacguucgagaaagucauugaacccauccuggagaauuauccuaacaaggagaugaaugaaaaaggcaaggaggugccauguaaccccuuucuuaaauacaaggaggaacaugguuauaucagaaaguacagcaaaaaggggaacggcccggaaauuaaauccuugaaguauuacgacucaaaacugggaaaucacaucgauauuaccccuaagaacagcaauaacaagguaguguuacagucuguuucccccuggagggccgacgucuacuucaauaaaacaacuggcaaguaugagauacucgggcugaaauacgcugaucuucaguuugagaagggaaccgguacauauaaaaucagucaagaaaaguacaacgacauuaagaaaaaggagggcguggauagcgacucugaguucaaauuuacucuguauaagaaugauuugcuccuggugaaagacaccgaaacgaaggaacagcagcuauuccgauuucugucccgcacaaugccuaaaaagaagcacuacgucgagcucaaaccauaugauaagcaaaaauucgagggaggagaagcacugaucaagguucuuggcaacguggccaauucaggucagugcauuaaaggguuggcuaagaguaacaucagcauauacaaggugcggaccgacguacugggcaaucagcauaucauuaaaaacgagggagauaagcccaaauuagacuucuga

SEQ ID NO: 2783 - RNA, 3366 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauuugguaaggcggacaaaccgccaaggacgacguuuaacuagaaggaagaaacaucggcgcgugagacugaauaggcuauuugaggaaucaggccucauuacggacuucaccaagaucaguauaaaccugaauccuuaccagcuucgggucaaaggucugacagaugaguugagcaacgaagaacucuuuaucgcccugaagaauauggugaagcaccgcgggauuuccuaucuggacgaugcgucugacgauggaaacucgucaaucggcgacuacgcucagauuguuaaagagaauagcaagcagcucgaaacuaaaaccccaggccaaauccaguuagagcgauaucagacauacgggcagcugagaggagauuucaccguggaaaaggacgguaaaaagcauaggcuuauaaacgucuuuccgacuagcgccuaucgguccgaggcauugcguauucugcaaacacagcaggaguucaauccccagaucaccgaugaauuuauuaaccgcuaccuagagauccucacgggcaagagaaaauauuaccacgggccuggaaaugaaaagucuaggacugacuacggccgguaucgaaccagcggugagacacuggauaacaucuucgggauucuuauaggaaaaugcacuuuuuacccagacgaguuccgcgccgcuaaggcauccuauaccgcccaagaguuuaaccuguugaaugaccucaacaaucugacagugcccaccgagacgaaaaaguuaucaaaagaacagaagaaccagaucauuaauuacguaaagaacgagaaagcuaugggcccugccaagcuguucaaauauaucgcgaagcuccuuaguugugauguugcagacauaaaaggcuacagaauugauaagagcgggaaggccgaaauccauacuuuugaggcuuauaggaaaaugaagacacuggaaaccuuggacaucgagcaaauggaucgggagacucuagacaaacuggccuacgugcucacacugaauaccgaacgcgaggguauucaggaagcacuugagcacgaguucgcugauggaucuuucucccagaagcaggucgacgaacuggugcaauuuagaaaagccaacucaagcaucuucggcaagggguggcacaauuuuagugugaaguugaugauggagcucauuccagaacuguacgagacgucugaggaacagaugaccauauuaacaaggcugggaaaacagaagacuaccuccagcucgaacaaaacaaaguauaucgaugagaaacuacucacugaagagauuuacaaucccgucguugcgaagucugugcgucaggccaucaagaucguaaacgcagcuauuaaagaauauggcgacuucgauaauauagugaucgagauggcccgggaaaccaacgaggacgacgagaagaaagcuauucaaaagauccagaaagccaauaaggaugaaaaagacgcagccaugcugaaggcugcgaaccaguacaacgguaaggcagagcuuccucauuccgucuuucacgggcauaaacaguuggccacaaagauucgacuguggcaccaacagggcgaaagaugccucuauaccggaaaaacuaucucaauacacgaucugaucaauaacaguaaucaguucgagguggaccauauucuuccacugagcaucacguuugaugacuccuuggcuaacaagguucucguguacgccacagcaaaucaggaaaaaggccaaaggaccccguaucaggcccuggauucuauggacgaugcuuggagcuuccgcgaguuaaaggccuuuguccgggagucaaagacucugaguaacaaaaagaaagaauaccuacucaccgaggaagacauuuccaaguucgaugugaggaaaaaguuuaucgagagaaaucugguagacacacgcuacgcaagccgaguugugcuuaacgcguugcaggaacacuuccgggcucauaagauagauaccaaagucucugugguccgugggcaauuuacuucacagcugagaaggcacuggggaauugagaagacacgcgacacguaucaucaccacgccguggacgcacucaucauugccgcuaguagccagcugaauuuauggaaaaagcagaaaaacacccugguuuccuacucugaggaucaacuuuuggacaucgaaacuggugagcucauaucggaugacgaauauaaggagagcguguucaaggcccccuaccagcauuucguagauacacugaaauccaaggaguuugaagacucaauccuauucaguuaucaggucgauucuaaauuuaaucggaagauuagcgacgcaaccaucuacgcuacaagacaggccaaagugggcaaggauaaagcggacgagacuuauguucuggggaagauuaaggauaucuacacccaagacggauacgaugccuucaugaaaauauauaagaaagacaaguccaaauuucucauguacaggcacgacccucagacguucgaaaaggugauugagccaauccuggaaaacuaucccaauaagcagaucaacgagaaaggcaaggaggucccuuguaauccauuucuuaaauacaaggaggaacaugguuauauucgaaaauacucaaagaaggggaacggccccgaaaucaaaaguuugaaguauuacgauucuaaacugggaaaccacauugacauaaccccgaaggauuccaauaacaaagugguauuacagagugugagcccuuggcgcgcugacguuuacuucaauaagacaacuggcaaguaugagauccucgggcugaaauacgcagaucuucaauuugaaaagggaaccgguacauauaaaauuucucaggagaaguacaacgacaucaaaaagaaggagggcgucgauuccgacucagaguucaaauuuacucuguauaagaaugauuugcuccuggugaaagacaccgaaacgaaggaacagcaacuauuccgguuucugaguagaacaaugcccaaacagaagcacuacguggagcucaaaccauaugauaagcagaaguucgaagggggagaggcccugauuaaaguccuuggcaacguugcuaauagcggucagugcaagaaaggguugggcaagucgaacaucuccauauacaaagugaggaccgacgugcugggaaaucaacauaucauuaagaacgagggcgacaagccuaaauuagauuucuga

SEQ ID NO: 2784 - RNA, 3366 nt, Artificial Sequence
  Cas9 variant
augagcgaccuggugcucggccuugauauagggauuggauccgucgguguuggcauacugaacaaggugaccggggagaucauucacaaaaauucuagaaucuuccccgccgcucaggcagaaaacaauuugguaaggcggacaaaccgccaaggacgacguuuaacuagaaggaagaaacaucggcgcgugagacugaauaggcuauuugaggaaucaggccucauuacggacuucaccaagaucaguauaaaccugaauccuuaccagcuucgggucaaaggucugacagaugaguugagcaacgaagaacucuuuaucgcccugaagaauauggugaagcaccgcgggauuuccuaucuggacgaugcgucugacgauggaaacucgucaguuggcgacuacgcucagaucgugaaagagaauagcaagcagcucgaaacuaaaaccccaggccaaauucaguuagagcgauaucagacauacgggcagcugagaggagauuucaccgucgaaaaggacgguaaaaagcauaggcuuaucaacguguuuccgacaagugccuaucgguccgaggcauugcguauacugcaaacucagcaggaguucaauccccagauuaccgaugaauuuguaaaccgcuaccuagagauccucacgggcaagagaaaauauuaccacgggccuggaaaugaaaagucuaggacugacuacggccgguaucgaaccaacggugagacacuggauaacauuuucgggauccuuaucggaaaaugcacuuuuuacccagaagaguuccgcgccgcuaaggcaagcuauaccgcccaagaguuuaaucuguugaacgaccucaauaaccugacaguucccaccgaaacgaaaaaguuauccaaagagcagaagaaucagauuauaaacuacgugaagaaugaaaaagcuaugggcccugccaagcuguucaaauauaucgcgaagcuccuuucaugugacgucgcagauauuaaaggcuacagaaucgacaagagugggaaggccgagauacauacuuuugaggcuuauaggaaaaugaagacacuggagaccuuggauauugagcaaauggaccgggaaacucuagauaaacuggccuacgugcucacacugaacaccgagcgcgaaggaauccaggaggcacuugaacacgaguucgcugacgguagcuucucucagaaacagguggaugagcugguccaauuuagaaaagccaauuccucaaucuucggcaagggguggcacaacuuuagcguuaaguugaugauggaacucauuccagagcuguacgaaacgagugaggagcagaugaccaucuuaaaaaggcugggaaagcagaaaacaacuucuuccagcaauaagaccaaauauauugacgaaaagcuacucacagaggaaauauacaaccccgugguagcgaagucgauccgucaggccauuaaaaucgugaaugcagcuaucaaggaguauggcgauuucgacaacauugucauagaaauggcccgggagacuaaugaggaugacgaaaagaaggcuauccagaaaauucaaaaggccaacaaagacgagaaggaugcagccaugcugaaggcugcgaaccaguacaaugguaaagcagaacuuccucauucuguguuucacgggcauaagcaguuggccaccaaaauccgacuguggcaccaacagggcgagagaugccucuauacaggaaagaccauuuccauccacgaccugauaaacaauccaaaccaguucgaaguugaucauauccuuccgcugucaauuacuuuugacgauaguuuggcuaauaaagugcucgucuacgccacggcaaaccaggagaagggccaaaggacacccuaucaggcccuggacagcauggaugacgcuugguccuuccgcgaguuaaaggccuuugugcgggaaucuaaaacccugagcaauaagaaaaaggaguaccuacucacugaagaggauaucucaaaauucgacguaagaaagaaguuuauugaaaggaaccugguugauacccgcuacgcaagucgagugguccuuaaugcguugcaggagcacuuccgggcucauaaaaucgacacaaagguguccgucgugcgugggcaauuuaccagccagcugagaaggcacuggggaauagagaaaacucgcgauacauaucaucaccacgccguugacgcacucauuaucgccgcuucuucacagcugaacuuauggaagaaacagaagaauacgcuggugaguuacagcgaagaccaacuuuuggauauugagaccggugaacucaucuccgacgaugaguauaaggagucuguauucaaagccccuuaccagcauuucgucgacacucugaagucgaaagaauuugaggauagcauacuauucuccuaucagguggacucaaaguuuaaccggaaaaucagugaugcaacaauuuacgcuaccagacaggccaagguuggcaaagacaagaaggaugaaacauaugugcuggggaaaaucaaggacauuuacacucaagauggauacgacgcguucaugaaaaucuauaagaaagauaagucuaaguuucucauguacaggcacgacccacagaccuucgagaaagucauagaacccauucuggagaauuauccuaacaaggagaugaaugaaaaaggcaaggaggugccauguaaccccuuucuuaaauacaaggaggaacaugguuauauccgaaaguacagcaaaaaggggaacgacccggaaaucaaauccuugaaguauuacgauucaaaacugggcaaucacauugacaucacgccuaaggauagcaacaauaagguaguguuacagucuguuucccccuggcgcgccgacgucuacuucaacaaaaccacaggaaaguaugagauucucggccugaaauacgcugaucuucaguuugagaaggggacuggaaccuauaaaauaagucaagaaaaguacaaugacaucaagaaaaaggaggguguggauagcgacucugaguucaaauuuacacuguauaagaacgauuugcuccuggugaaagacacugaaaccaaggaacagcagcuauuccgguuucuguccagaacgaugccaaaacaaaagcacuacgucgagcucaagccuuaugauaaacagaaguucgagggcggggaagcacugauuaaaguucuuggaaauguggccaacucaggccagugcaagaaagguuuggggaagaguaauaucagcauuuacaaggugaggacagacguacugggcaaccagcauaucaucaaaaaugagggagacaagcccaaauuagauuucuga

SEQ ID NO: 2785 - RNA, 3366 nt, Artificial Sequence
  Cas9 variant
augaacggccuggugcucgggcuugacaucggaauugccagcgucgguguuggcauacuggagaaaaauuccgggaaaaucauucacgcuaacucuagauuguuccccgcagccaccgcggauaauaacguggaaaggcggaagaaucgccaggcucgacguuuacauagaaggaaaaagcaccggggaguacgcuuucaagaccuguucgaggauuacggccuacucacagacuuuucaaaagugaguaucaaccugaauccuuauagacuuagggucgauggucugaaccagcaguugacuaaugaagaacucuucauugcccugaagaacaucgugaagcggcgcgggauaagcuaccuggacgaugcauccgaagacggaggcacgguuucuucggauuauggcaaagccguggaggagaaucgaaagcucuuagcugaacagaccccagggcaaauccagcuggagagauuugaaaaauacggacaggucaggggugacuucacagugguagagaacggcgagaagcggcgucuuauuaauguuuucucaacuagcgcauaucgcaaagaagccgagagaaucuugaggaagcagcaagaauuuaacaguaagauuaccgaugaguuuaucgaagacugccugaaaauacuaacagggaagcggaaauacuaucauggaccgggcaaugagaagucccgaaccgauuacggucgcuucagaacugacgggacaacccucgacaacauuuuuggaauccugauuggcaaauguacguucuaccccgaugaguauagggcuucuaaggccagcuacacugcgcaggaauuuaaccuucugaaugacuugaacaaucucaccgugccuacagagacuaaaaagcuguccgaggagcagaagaaagucaucguggaauaugcaaaggaggccaaaaccuuaggcgcuucaacacugcucaaguacaucgccaaaaugauugaugcaaguguggaccagauacggggguaucgcgucgauguuaacaauaagccagagauccacaccuucgaggcuuacagaaagaugcaaagccuugaaacgauuucugugggagaacuguccaggaacguauuggacgagcuagcccauauccugacucucaauacagaacgugaggguauagaggaagcgauuaacaccaaacugaaggauucauucagccaggaccaggugcuugagcugguccaauuucggaaaaauaacaguucuuuguucuccaagggcuggcacaauuuuagccucaaacugaugauggaauuaauccccgagcuguaugagacuucggaggaacagaugacaauccuaacccgacucgggaagcagaagucuaaagaaauuuccaagagaacgaaauacaucgaugagaaggaacugaccgaggagauuuacaacccugugguugccaaaucagugaggcaggcaauaaagaucauuaaugaagcuacaaagaaacacggaaucuucgacaacaucgucauugagauggcccgcgaaaauaacgaggaagaugcuaagaaagacuauauaaagcggcaaaaagccaaccaggacgagaagaaugcagccauggagaaagcugcguuucaguacaacggcaagaaggaacuuccagauaguaucuuccauggucagaaagaguuggcaacuaagauuagacuguggcaccaacagggggaaaaaugccucuauaccggcaagaauauccccauuagcgaccugauccauaaccaguacaaauaugagauagaucacauccuuccucuguccuugucuuuugacgauagccucucaaauaaggugcugguauuagccacagcuaaccaggaaaagggacaaaggacuccauuccaggcccuggacaguauggaugacgcaugguccuaccgcgaguuuaaaagcuauguuaaggagucuaaacuacucggcaauaagaaaaaggaauaccugcuuaccgaggaagauauuucaaagaucgaggugaaacagaaguucauugagcgaaacuugaucgacacacgguacaguagccgugucgugcugaaugcccuccaggauuuuuauaaagcucacaaguucgacaccacuauauccgucgugagagggcaauuuacgucucagcugaggcgcaaauggggauuagaaaagucgcgggagacauaccaucaccaugccguugaugcacugauuaucgcggcuagcucccagcuuagauuguggaagaaacaaaacaauccgcucauugccuauaaggaaggucaguucguggacucagagaccggcgaaaucauaagucugucugacgaugaguacaaagagcuaguauucaaggcacccuaugaccacuuugucgauacucugagcuccaaaaccuucgaagacucaauccucuuuagcuaccagguggauucuaaguucaacaggaaaauuuccgacgccacaaucuaugcuacccgaaaggccaagcuggauaaagagaagagugaagagacuuacguucuugggaaaauuaaggacaucuacagccaggcaggauaugaugcuuuuauaaaaauuuacaauaaggacaagucuaaauucuugauguaucauaaggauccucaaacauuugaaaaagugaucgaggagauccugcgcacguacccauccaaggaauuaaacgacaaaaauaaggagauucccuguaacccuuucgaaaaguaucggcaggagaacggcccaaucagaaaauacucaaagaaaaguaauggucccgaaauuaagagccucaaauauuacgauaacaagcuggggaaucacauagacaucaccccggagucguccgacaaccaggucgugcuucagucucugaagccuuggaggacugauguauacuuuaaucaccaaacaaagaaguaugaguugaugggccucaaauacagcgaccugucauucgaaaagggaaguggcaaauauuccauuucuaaccagaaguacaauagcaucaagcguauugaggggaucgaugaacaguccgaguuuaaauucacccuauauaagaacgaccugauacucaucaaagauucagagaauaacgaacagaagcuguuucgcuucaauagccggaacgacacagccaaacauuacauugagcuuaagcccuaugauaaagcgaaguucgacggagaacaagaguugaucacuauucuggguaauguggccaagggcgggagaugcuuaaaaggacucaacaagaguaauaucucuauauuuaaaguuaagaccgauguccugggcaaaaagcacauuaucaagaaagaaggugacgagccaaaacuuaaguucuga

SEQ ID NO: 2786 - RNA, 3366 nt, Artificial Sequence
  Cas9 variant
augaacggccuggugcucgggcuugacaucggaauugccagcgucgguguuggcauacugaauaaggauaccggggagaucauucacacaaacuccagaaucuuccccgcugcaacugccgacaauaacguggaaaggcgcaauucucggcaggaucgacguuugaacagaaggaaaaagcaucggggaguacgcuuacacgaccuguuugaggauuacgaccuacucacggauuucucaaaagugaguauuaaucugaacccuuauagacuuaggguccaaggccuggacaauagcuugaccacagaagaacucuuuaucgcgcugaagaacauagugaaacggcgcgguaucuccuaccuggaugacgcuucugaagaugggggaguugugucgucagacuauggcaaggccgucgaggagaaucgaaagcucuuagcagaacagacuccaggccagauucagcuggagagauucaaaaaguacgggcaagugaggggagauuuuaccguaguugaaaacggugagaaacggcgucuuaucaauguguucagcacaagugccuaucgcaaggaggcugaaagaauuuugaggaaacagcaggaguuuaacaaucagaucaccgacaaguucauagaagacuaccugaagauucuaacugagaaacggaaguauuaccauggcccggggaacgaaaaaucccgaacagauuacggacgcuuuagaaccgacggcacgacucucgauaacaucuucgguauucugaucgggaagugcaccuuuuaucccaaugaguacagggcaucuaaagccagcuauacagcucaagaguucaaccuucugaaugacuugaacaaucucacugucccuaccgaaacaaagaaacuguccgaggaacagaagaagaccaucguggaguacgccaaaucagcgaagacguuaggagcaaguacucugcucaaauauauugccaagaugauagaugcuagcguggaccagauccggggcuaccgcgucgauguuaacaauaaaccagaaaugcacacauuugagguguauagaaagaugcagucucuugagaccauuuccguaugggaacugucaaggaacaucuuggacgagcuagcccauauacugacucucaauacagaacgugagggcauugaagaggcaaucaacaccaagcugauggauguguucagccaagaccagguccuugagcuggugcaguuccggaaaaauaacaguucuuuguuuuccaagggguggcacaauuucagccgaaaacucaugauggaacugauccccgaguuauacgaaacgucggaggagcaaaugaccauucugacaagacuaggaaagcagaaaucuaaggaaacuuccaagaggaccaaauacaucgaugagaaggaaguuacagaggaaauuuauaacccuguggucgcuaaaucagugcgccaggccauaaagaucauuaaugaggcgacuaaaaaguacgguaucuuugacaacaucguaauugagauggcccgggaaaacaaugaggaagacgcaaagaaagauuauauaaagagacagaaagcuaaccaagacgagaagaauguugccaucgaaaaagcugccuuccaguacaacggcaagaaagagcucccagauaguauuuuucacgggcauaaggagcuggcaaccaagaucaggcuuuggcaccagcagggagaaaaauguuuguauacaggcaagaauauucccaucagcgaccugauacauaaccaauacaaauaugagaucgaucacauucucccucugucccuuucuuucgacgauagccugucaaauaagguguugguccucgccaccgcuaaccaggaaaaaggucagcgcacuccauuucaggcgcuggacaguauggaugacgcaugguccuaccgagaguucaagagcuacgugaaggauucuaaauuacuggggaauaagaaaaaggacuaucuacucacggaagaggauaucucaaaaauugaggucaagcaaaaguuuaucgaacggaaccugguggacacacguuacaguagcagaguugugcuuaauaccuugcaggacuucuauaaagcccacaaguuugauacuaccauauccguagucaggggccaguucacaucucagcugcgccggaaauggggacucgagaagucgagagaaaccuaccaucaccaugcuguggacgcccugauuaucgcagccagcucccaauuaaggcuguggaaaaagcaggcuaacccgcuuauuucauauaaggaggaucaguuuguugacagugagacuggcgaaaucauaucuuugacagaugacaaauacaaggagcucguguucaaagcccccuaugcacacuucgucgauacgcugagcuccaagaaauuugaagacucaauccuauucagcuaccaaguggauucuaaguacaaucgaaaaauuuccgacgcgaccaucuaugcuacucgcaagguaaagcuggauaaagacaagagugaggaaacauacgugcucgggaaaauuaaggauaucuauagccaggccggauacgacgcauuuauaaaaauuuauaacaaggacaagucuaaauuccugauguaccauaaggauccucagaccuuugagaaaguuaucgaggaaauccuucggauuuauccauccaaggaguucaaugagaaaaacaaggagguccccugcaacccuuuugaaaaguacagacaggagaaugguccaaucuguaaauacucaaagaaaggcaacgggcccgagauuaagaguuugaaauauuacgacaagaauauaccggaaaguuucaucgauauuacaccuucgaacuccaagaauaaagugauccugaggcaauuaaaccccuggcguacugacguguauuuuaaucaccagaccgagaaguacgaacuccugggacuuaaauaugccgaucugcaguucgagaagaaaacggaaaccuacucuauuacaaucgacaaguauaacgagauaaaggagaaagaaggcgucggugagcacagcgaauuuaaguucacuuuguacaaaaaugaucuccugcuaaucaaggacauggagauuaaagaggaacagaucuuucgcuuccugucacggaccaugccaaacaagaaacauuacguugagcucaagccuuauuacaaggggaauuucgaaggcaaagagagaauuaagguguuuaacacaacuagcaauggaaggugccugaaaggccuugggaagaaaggauuguccaucuauaagauaaagaccgaugugcuggguaacaaacacuucauuaagaaagaaggcgagaagcccaaauuaaaguuuuga

SEQ ID NO: 2787 - RNA, 3366 nt, Artificial Sequence
  Cas9 variant
auggacagaaccgaggugaacaucggcuucgauauugggauaagcuccgucggauggucuguuguggccacaaagucagguaggauccuggaaaguggcguaagccucuuuuccggggcuucugcagccaaaaaugaggaacggcgcaacuuccgacagucgcguagacuucugaggcggcgcaagaauagaauuucagacuugaaaaaguacuuaaaagagcagagcuuuacuuauaacggagaacugcuaaaugagaaccccuacgagaucagggugaagggccucacggaaaagcugaguaaagaggaaauugcgcuugcucuguugcacaucgucaagcggcgcgguguguccuaugaucucggggacauagaggaggaaggaaccacaggcucuuacaaagagggcguuaagaaaaaucaaaagcugcugaaggaaaagacuccugccgagauccaguuccagcgacucaagaaauuucauaaggugagagggcaaauugcaaucgaugaaaacgacgucuuacugaauguguucccaaaccacgccuauguagaugaggcucagcagauucuuuacacccagcaagaguuuuauccggaaaucaaugagacauucauaaaccagguuaccgacuuuauuagcaggaaacgggauuacuucaucggacccgguuccgaaaagucacguacugacuacggcauuuaucgcacagaugggaccacguugcagaaucuguuuaguauccuaaucggaaaagacaagauuuucccugaugaguuuagagcagccggcaacagcuacacugcucagguguauaaucuccugaacgaccuuaacaaucuggccauagacgauaccgaaacagguaaguugacuaaacaacagaaggagaaaaucauuauggagcucaagaccacagaaaaaucugucaacaugaugaagcugaucgcgaagaccgcaggggugacgguggagcagauauccagguaccggauuaaucgagacggaaaaucagaaauccauaacauggccgucuaucgcaagaucagaaaaguuuucuuagagcugggcuacgaaauuaaugaguggccaagccaacuccuugaugagcugggcgacgcuuugagucuaaacacugaaaauggggagaucaggcggauucugacagauaaccucgccaauaaguauaaaauacuggaccagcagcuuaucaaccugauuaucgaaaauaagaacgcauucaccuugucuacuaaucagaaguggcaccgcuuuuccuacaaaacaaugaagauccucauucccgagcuguuagagaccaacaaagaacaaaugacgauacugaccgagaugggacuaaugaagaaagaucagagaaauuacguggguaagaacaagaucgacagcgaagcucuccuggagaaccuuuauaauccuguagugaggaaaucgacacgucagacuaugaaguuguucaacacccugcucaaaaaguacccaaauauugccuaugucgugaucgaaaugccccgggaggaugacgaggauaaagcgcgaagagacuacguuaaguuucagaaagacaacgaaaaggagaaggaugccgcacugaaaaauuucauuauggaaucuggcaaguccgaggcugaagugaucgccaaauauaggcaaucaaagaaauuucgcaguaagguccggcuuugguaccagcagauggggagaugccuguauagcggaaaggcuaugccugccgagaggguguuccgcgacgaucauuuuacagacauagaucacguaaucccauuguccguuucuuucgacgauggcaugaacaauaaagugcucugucuggcagagaugaaccgacagaaggacaaacaaacuccguacgccuuuuucaaugcuggucacgggcagggcuuucaggcgaugaacgcaauguuaaagaauaacaaucggauuagcucagccaaaaagcguaaccugcuauucaccgaaaaucucaacgaucuggaggucagaaagagguuuaucgaacgcaaccuuguggacacacgguacgcuaguagagucguguugaaugagcugcagcaauucguuaaagccaagcagcucgauaccaaagugacuguaauuaggggaaaguucacguccaaacugcgagaaaaguggaacaucaauaagagccgcgacacacaucaccaucacgcagucgaugccgcugugauagccguuucucccauguuaaaccugugggagaaaggcgcaucaauuaucccuaauaaggugggggagaacgucauugacaucaaaaccggagaaauaaucacugaccacgauuaugaggcggacguguacgaacuuccauaugcuaaguuuuuggagcagauucccaaaguaaagaaagauaucaaguuccggcaucaaguggacaagaaaaagaauagaaaaguuagugaugccaccauuuacacaaccaggaaggcaaaagucgguaaggacaaggaggaaacugauuaugugcucggcacaaucaaagacauauacagccuggagggguauguguccuuuaagaaaauuuacaacaaggauaaagccaaguuccuaauggcucguaucgacccuaagacguuugaaaaacuggagaagaucgucgccgaauacccagagucuauugagguugugcaggauaauggaaaaguggacguacagaagaucucgcccuucgaacucuaucgcaaagauaacggcuuugucaccaaguucgcaaagaaaaauaacgguccggcuguuaagagccugaaauacuaugacuccaaacuugggucaaguauugacgugacuccugauaaugccaaaaacaagaaggugauauugcagucucugaaacccuggcggacagacgucuacuuuaaugaggaaaaccaagaguaugaaaucaugggcuuaaaguacagcgaucucaaauucggaaagaacggcaaauauggggugccaaagguuagauacgaggagauuaaacaggaagaggaaaucuccgagggaucaaaguuucuguucagccuuuacaggggugaccgaauuaaggugaccaaugaacugggcgagaacuuggaucuccuguuuucuucccggacacuaccugcgcagaaaggguauguagagcugaagcccaucgacaaaacuaaguucgauggaaaagaaaaggucaguuucuacggcaccgugacgccaaauggucaguuugugaagaaauucgccaagaaaggguauaagauacucaaacugaacaccgacgagcuuggcaauacauacaucgaaaacggagagaaggagcccagcgauauuuuggacauguga

SEQ ID NO: 2788 - RNA, 3366 nt, Artificial Sequence
  Cas9 variant
augaacggccuggugcucgggcuugacaucggaauugguagcgucggcguugggauacugaauaaggauaccggagagaucauucacgccaacuccagaaucuuccccgcugcaacagccgacaauaacgugguaaggcggucuucacgccagggccgacguuugaaucauaggaaaaagcacagaagugugcgguuaaaagaucuguuugaauacuaugaccuacucacugauuucagcaaggucuccauuaaccugaauccuuaccgccuuagagugaacggucugaaucaacaguugacgaacgaggaacucuuuaucgcgcugaaaaauauaguuaagaggcgggggaucucuuaucuggacgaugcuucggaggacggaggcgccgugucaagcgauuacggcaaggcagucgaagagaaccgcaaacucuuagccgagcagaccccagggcagauucaacuggaacgauucgagaaguauggacaggugagaggugacuuuacaguaguugaaaauggcgagaaaaggcggcuuaucaacguguucaguacuuccgcuuacaagaaagaggcagaacguauuuugcgcaagcagcaggaguauaauaaccaaaucauggaugaauuuauagccgacuaccugaccauucuaacagggaagagaaaauacuaucauggaccgggcaacgagaagucuaggaccgauuacggucgguuccgaacugacgggacaacccucgacaauaucuuuggcauucugaucggaaaaugcacguucuaucccgaaaaguaccgcgcuagcaaagccuccuauacugcgcaggaguuuaaccuucugaaugauuugaacaaucucaccgucccuacagagacuaagaaacugucagaagaacagaagaagaccaucguggaauacgcaaaaagugccaagacauuaggcgcuagcacccugcucaaauauauugccaagaugauagacgcaucuguggaucagaucagaggguacagggucgacguuaaaaacaagccagagaugcacacguucgaaguguaccggaagaugcaaucccuugagacuauuucaguaggagaguuuagccgcgaagugcuggaugaguuggcucauguccuaacacugaauaccgaaagagaggguaucgaagaggccauaaacacuaaacucagggacaguuucucucaggaucagauucuggagcuugugcaauuccguaagaauaacuccagccuguuuucgaaaggcuggcacaauuucucuuugaagcucaugauggaacugauccccgaguuauaugaaacauccgaggagcagauggcgauccugacccggcuagggaaacagaaguuuaaggaaacgucaaaacgaaccaaguacauugacgagcaggaaguuacagaggaaaucuauaacccuguggucgccaaaagugugagacaagcaauuaagauaaucaaugaggcuacuaaaaaguacggaauuuucgauaacaucguaaucgagauggccagggaaaauaacgaggaagaggcuaagaaagacuauauuaagcgccagaaagccaaccacgaugaaaagaaugcagccauggagaaagcugcguuucaguacaacggcgagaaggaacucccagacagcauauuccauggucacaaagagcuggcaaccaagguucggcuuuggcaucagcaaggggaaaaguguuuguauacaggcaaaaauauccccauuuccgaccugauccacaaccaguacaaguacgagauugaucacauccucccucugucucuuagcuuugacgauucacugaguaauaaaguguugguccucgccacugcuaaccaggaaaagggacagagaaccccauuccaagcccuggacuccauggaugacgcauggagcuauagggaguuuaaaucuuacgugaaggauucaaagaguuuaggcaauaaaaagaaagacuaucugcuaacagaggaagauauaagcaagaucgaggucaaacagaaguucauugaacgcaaccucguggacacccgauacuccucucggguugugcugaauacucuucaggauuuuuauaaggcccauaaauucgacacgacaaucucgguaguccgugggcaguuuaccagccaauugagaaggaaguggggacuggagaaaucccgcgagacuuaccaccaucacgcuguggaugcccucauuaucgcagcgucaagucagcugcgguuauggaagaaacagaacaauccgcugauaucuuauaaggaaggucaauucguugacagcgagaccggcgaaauuaucucccuuacagacgaugaguacaaggaauugguguucaaagcucccuacgaccauuuugucgauacccucagaucaaagaaauucgaggacagcauucuguuuucuuaucagguggauuccaaguucaacaggaaaaucagugacgccacuauauacgcaacacgaaagacgaaacuagauaaggacaagagcgaggaaaccuauguacuggggaaaaucaaggauauuuacucucaguccggauaugacgccuuuaucaaaauuuacaauaaggauaaaucaaaguuccucauguaucacaaggacccucagacuuuugagaaagugaucgaagagauacugcgcacauacccaaguaaggaguucaacgagaaaaauaaggagguuagcugcaaccccuuugaaaaauacaagcaagagaacggcccuauucggaaguauucgaaaaaggguaaugggccagaaaucaaaucccuuaaguacuaugauaaaaacauccccgagucuuucauuaauaucaccccgagcaacucaaagaauaaggucauuuugagacagcugaacccuuggaggacagacguguacuuuaaucaccagacugaaaaauaugaguuacucggccugaaguacgcugaccuucaguucgagaaaaagaccggaacguauaguauaaccaucgauaaauacaacgaaauuaaggagaaggaaggcguguccgagcauucugaguuuaaauucacacuguacaagaaugacuugcuccugaucaaagauacugaaauuaaggaggaacaaaucuuccguuuucuaagccgcaccaugcccaaccagaaacacuaugucgagcugaagccauacuauaaagggaauuucgaaggaaaggagcggauaaagguuuuuaacacaacuuccaaugguagaugucucaaaggccugaggaagaaagggcuuucaaucuacaagauuaaaaccgacguguugggaaacaagcauuucaucaagaaagagggcgaaaagccuaaacugaaguuuuga

SEQ ID NO: 2789 - RNA, 3366 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauuugguaaggcggacaaaccgccaaggacgacguuuaacuagaaggaagaaacaucggauugugcgccugaauagacuauuugaggaaucaggccucaucacggacuucaccaagauaaguaucaaccugaauccuuaccagcuuagggucaaaggucugacagaugaguugagcaacgaagaacucuuuauugcccugaagaauauggugaagcaccgggggaucuccuaucuggacgaugcgucugacgauggaaacucgucaguuggcgacuacgcucagauugugaaagagaauagcaagcagcucgaaacuaaaaccccaggccaaauccaguuagagcgcuaucagacauacgggcagcugcgaggagauuucaccgucgaaaaggacgguaaaaagcauagacuuauaaacguguuuccgacuagcgccuauagguccgaggcauugcggauucugcaaacacagcaggaguucaauccccagaucaccgaugaauuuauuaaccguuaccuagagauccucacgggcaagcgcaaauauuaccacgggccuggaaaugaaaagucuagaacugacuacggcagguaucggaccagcggugagacacuggauaacaucuucgggauucuuauaggaaaaugcacuuuuuacccagacgaguuccgagccgcuaaggcauccuauaccgcccaagaguuuaaccuguugaaugaccucaacaaucugacaguacccaccgagacgaaaaaguuaucaaaagaacagaagaaccagaucauuaauuacguuaagaacgagaaagcuaugggcccugccaagcuguucaaauauaucgcgaagcuccuuaguugugauguggcagacauaaaagaauaccgcauugauaagagcggcaaggccgagauccauacuuuugaggcuuauagaaaaaugaagacacuggaaaccuuggacaucgagcaaauggauagggaaacucuagacaaacuggccuacguccucacacugaauaccgagcgggaagggauucaggaggcacuugaacacgaguucgcugauggaucuuucucccagaaacagguggacgagcuggugcaauuucgcaaggccaacucaagcaucuucgguaagggcuggcacaauuuuagugucaaguugaugauggaacucauuccagagcuguacgaaacgucugaggagcagaugaccauauuaacaagacuggggaaacagaagacuaccuccagcucgaacaaaacaaaguauaucgaugaaaaacuacucacugaggaaauuuacaaucccguuguggcgaagucuguaaggcaggccaucaagaucgugaacgcagcuauuaaagaguauggagacuucgauaauauagucaucgaaauggcccgugagaccaacgaggacgacgaaaagaaagcuauucaaaagauccagaaagccaauaaggaugagaaagacgcagccaugcugaaggcugcgaaccaguacaacggcaaggcagaacuuccucauuccguguuucacggucauaaacaguuggccacaaagauucggcuguggcaccaacagggggagcgaugccucuauaccggcaaaacuaucucaauacacgaucugaucaauaacaguaaucaguucgaaguugaccauauucuuccacugagcaucacguuugaugacuccuuggcuaacaaggugcucgucuacgccacagcaaaucaggagaaaggacaaagaaccccguaucaggcccuggauucuauggacgaugcuuggagcuucagggaguuaaaggccuuugugcgcgaaucaaagacucugaguaacaaaaagaaagaguaccuacucaccgaagaggacauuuccaaguucgauguacggaaaaaguuuaucgaaagaaaucugguugacacaagguacgcaagccgcgugguccuuaacgcguugcaggagcacuuccgagcucauaagauagauaccaaagugucugucgugcggggccaauuuacuucacagcugcguagacacugggggauugagaagacaagggacacguaucaucaccacgccguugacgcacucaucauugccgcuaguauccagcugaauuuauggaaaaagcagaaaaacacccuggugagcuacuccgaagaucaacuuuuggacauagagacuggagaacucaucucugaugacgaguauaaggagucgguauucaaggcccccuaccagcauuucgucgauacacugaaaagcaaggaauuugaggacuccauucuauucucauaucagguggauaguaaauuuaaucgcaagaucucugacgcaaccauuuacgcuacacggcaggccaaaguugguaaggauaaagcggacgaaacuuaugugcugggcaagaucaaggauauauacacccaagacggguacgaugccuucaugaaaauuuauaagaaagacaagagcaaauuucucauguacagacacgacccucagacguucgagaaggucaucgaaccaauccuggagaacuaucccaauaagcagauuaacgagaaaggaaaggaagugccuguaaauccauuucuuaaauacaaggaggaacauggcuauaucaggaaauacuccaagaaggguaacgggcccgagauuaaaucauugaaguauuacgauagcaaacugggcaaccacauagacaucaccccgaaggauucuaauaacaaagugguuuuacaguccgucaguccuuggcgagcugacguguacuucaauaagacaacuggaaaguaugaaauucucggccugaaauacgcagaucuucaauuugagaaggggaccggaacauauaaaaucagccaggagaaguacaacgacauuaaaaagaaggaagguguggauucugacuccgaguucaaauuuacucuguauaagaaugauuugcuccuggucaaagacaccgaaacgaaggagcagcaacuauuccgcuuucugucacggacaaugcccaaacagaagcacuacguugaacucaaaccauaugauaagcagaaguucgagggcggggaggcccugaucaaagugcuuggaaacguggcuaauaguggccaguguaagaaagguuuggggaagaguaacauaucgaucuacaaaguaagaaccgacguccugggcaaucaacauauuaucaagaacgaaggagacaagccuaaauuagauuucuga

SEQ ID NO: 2790 - RNA, 3366 nt, Artificial Sequence
  Cas9 variant
augaacggccuggugcucgggcuugacaucggaauugccagcgucgguguuggcauacuggagaaaaauuccgggaaaaucauucacgcuaacucuagauuguuccccgcagccaccgcggauaauaacguggaaaggcggaagaaucgccaggcucgacguuuaaacagaaggaaaaagcaucggggaguacgcuuucaagaccuguucgaggauuacggccuacucacagacuuuucaaaagugaguaucaaucugaacccuuauagacuuagggucgauggucugaaucagcaguugacuaacgaagaacucuucauugcccugaagaauaucgugaagcggcgcgggauaagcuaccuggacgaugcauccgaagacggaggcgccguuucuucggauuauggcaaagcuguggaggagaaccgaaagcucuuagcagaacagacgccagggcaaauccagcuggagagauuugaaaaauacggacaggucaggggugacuucaccgugguagagaauggcgagaagugccggcuuauuaacguuuucucaacaagcgccuaucguaaagaagcugagaagaucuugcgcaagcagcaagaauuuaauaaccagauuacugaugaguuuaucgaagacuaccugaaaauacuaaccgggaagagaaaauauuaccacggaccgggcaacgagaagaguaggacagauuacggucgguuccgaaccgacgggacuacacucgacaauauuuuuggagugcugaucggcaaauguaccuucuaucccaacgaguaccgcgccuccaagucuagcuauacggcgcaggaauuuaaucuucugaacgauuugaauaaccucacugucccuaccgagacaaagaagcuguccgaggagcagaagaaagugauuguggaauacgcaaaggaggccaaaacuuuaggcgcuucaacccugcucaaguauaucgucaaaaugaucgacgccaguguugaucaaauuagcggguacagaguggacguaaauaacaagccagagaugcauacauucgaaguguauaggaagaugcagucucuugagaccauauccgucggagaacugucacggaauguguuggaugagcuagcacacauccugacgcucaacacugaacgcgaggguauugaggaagcuaucaauagcaaacugaugggcguuuucagucaggaccaagugcuugagcugguccaguuuagaaagaacaauucuuccuuguucagcaaaggguggcauaacuuuucgcucaagcugaugauggaauuaauacccgagcuguacgagacaucugaggaacagaugaccauucuaacuaggcucggaaaacagaaguccaaggaaacaucaaaacguaccaaguacaucgaugagaaagaacugacggaggagaucuauaauccugugguagccaagaguguucggcaagcgauuaaaaucauuaacgaagccaccaagaagcacggcauauucgacaacaucgugauugagauggcacgagaaaauaacgaggaagaugcuaaaaaggacuacaucaaaagacagaaggccaaucaggaugagaaaaacgcugccauggagaaggcagccuuucaguauaaugguaaaaaggaacuuccagggaacaucuucaauggccacaaggaguuggcuacaaaaauuaggcuguggcaucaacagggagaaaagugccucuacacuggcaaaaccauacccaucagcgaccugauucacaaccaguauaaguacgagaucgaccauauucuuccucuguccuugucuuuugaugacagccucucaaauaaaguccuggugcacgcgacagcaaaccaggaaaaggggcaacgcacuccauuccaggccuuagauaguauggacgaugcuugguccuaucgggaguuuaagagcuacgucaaagaccugaagucucuaucaaauaaaaagaaagauuaccuccugaccgaggaagacaucaguaagauagaggugaagcagaaauucaucgaaagaaaccuuguugauacaagguauagcucccgcgugguauugaaugcccugcaggacuuuuacaagucucaccaauucgauaccacuauuucggucgugcgaggacaguuuacgagccagcuccggcguaaauggggucuggagaaguccagagagacauaucaucaccaugcaguugacgccuuaaucauugcugccucaagucaacugaggcuuuggaaaaagcagaacaauccguugaucaccuacaaggaaggccaguucguggauucucagacuggggagauaauuagccucaccgacgacgaauauaaagagcuggucuucaaggcacccuacgaucacuuuguggacacacuacauuccaaaaccuucgaagauggaauccuguuuucauaucaaguagacagcaaguacaaccgcaaaauuucugaugcgacuaucuacgcuacacggaaggccaaacucgacaaggauaaguccgaggagacguaugugcugggcaaaauaaaggacaucuacagucaggcagguuaugaugccuucauuaaaaucuacaacaaggacaaaagaaaguuucuuauguaucacaaggauccucagaccuucgaaaaaguuauugaggaaaucuugaggacuuacccaagcaaggagcgaaaugacaaaaacaaggaaguccccuguaauccuuuugagaaauaucgccaggagaacgggccaauacggaaguacucuaagaaaggcaauggacccgaaauuaagugccugaaauacuaugauaacaaguuaggcaauuacaucgacaucuccccggacgggucagauaaccaaguggugcuccagagucugaaaccuuggagaacagacgucuauuucaaucaccagaccaaggaguacgaacuuaugggacugaaguauagcgauuugucguuugagaaagguuccggcaaguacucuauuagcaacgaaaaauauaauucaaucaagaggauugaggggguuaacgagcagagugaguucaaauuuacacucuacaagaaugaccugauacuaaucaaggauuccgaaaacaaugaacaaaaacuguuccguuuuaacucucgcaacgacacugcuaagcauuacguggagcucaaacccuaugauaaggcccgguucgacggacagcaggagcugauuaccauccuuggcaauguggcaaaaggugggcaauguuugaagggccugaacaaaagcaauauuuccaucuucaagguaaagacggaugucuuaggcaaaaagcacauaaucaaaaaggaaggagacgagccaaaacucaaguuuuga

SEQ ID NO: 2791 - RNA, 3366 nt, Artificial Sequence
  Cas9 variant
auggccgacaagacccugggcgcucucacauucggguuugauaucggaauugcaagcguggguuggugcguccuuggcgagaacagaauaguugaccugggggugagggccuucgauaaagcggaaacugcuaaggagggagaauccuugaauuuagcccggcgcacggcacgacugaugcguagaaggcuacggcgcagagccuggaggcucaccaaacuggcucggcuucugaagcgcgagggcuugaucgcagacgccuuucagaugcaccaacccucugcuacaucaccuuggaaacuccgaguagaagcccuggauagaaggcugacugacgaugagugggcgcgggugauuuaccaucucuguaagcaccgugguuuccauuggaucagucgcgcagaggaaaagaaagccgagggggacgcuaagggagaaagcggcagagucaaaaagggcuuauccgauacccagaggcggaugggggagaaaggauaucgaucugccgcagagauggugcuggcugaauuuccagaggcccagcgcaacaagcagggugacuacggcaaggcgcuuucgagaguuuugcugucagaagaacuagcccuccuguucaggcggcaacgcgaacuugggcacacacaugcaagcaaagagcuggaggcugccauuuugggaaauggcgauagaaagggugggcucuuuugggcucagaaaccgccccuggccggagcagacuuacugaagaugcucggcaaaugcaccuucgaaaaggaugaguauagggccccuaaagcuaguuuuacugcggaacgucacguguggcuuacacggcugaacaauuugcgagucgugguagacggcaccacgagaccacuaacugaggacgaaaggcgcguugcacugccccucccuuacggguaugccgaugcuaagcugaccuacaagcagcuucgggccgcacuguccaaagccggauugucuaacuucagcuuugcugguaucgccgacgauaaggagaaagacacacucacuaagcugccagcaugggagaccuuauccaaaacacugaagggcaaggggcuagaaaccgagugggaaggaauggcgggcgcugccacggguggggaucccacucuccuggacgagauaucaagagugcuuagugucuauaaagauggcgacgaaguggauguggaguugaggaagcugccucucccaggaggcgagaaaauggucgaaacacugagcgagaucucuuucgacaaguuucacgcacuuucccugaaagccuugcgcaagauuguuccgcauauggaaaccgggcuccgauacgaugaggcuugugccgcagcuggauaccaccauucacagcugcacgaggccggugcgggcgggcaaaaguauuuacccccuuucuacacucggcgugacaaagacggaagaaugguguucgaugaggagcuggacguaccaaggaaucccgugguccuacgcgcccucaaccaggcucggaaggugcugaaugcacuuguuagagccuauggcagcccuagugcugugcacaucgaaauggccagggauuugucuaaaccacuggucggucaucccacaccgaacgggggcuacauugagggacgacgcgacaucgaaaagcuccagaaagaguaucgggagagaaaugaaaaggauaaggcagcguuugccgcugagcacggcauagccgcaaaauccagggaguucgaaaaguuucagcuguaccgugaacaacaggggaaaugcgcuuauagcuuaaagccucuggaccuucaucgcguguugcacgauauuggauacgccgagguagaccaugcacuccccuacucgcggucuuaugaugacgguaaaaacaauaagguucuggugcuaaccgaggaaaacagaaauaaaggcaacaggacggccuacgaguaucugugugcuuucccagggggagaaaacggcgagcgauggcggaauuuugucgcguacguggaauccaacaagucauaucgccucgccaagagaaccaggcugcuucggaaagauuucggugggaaggcagcugaggaguuucgagaaagaaauuugaacgacacacgcuacaucugcaaauucuuuaagaauuucgucgagagguuucugcaguuaaaagugggcgccgauggaacugccgcuaagcguuguguugugcucaguggccaaaccacagcauuccugcgggccagaugggggcuucugaagguaaggggagcgagcgaccgccaccacgcuuuggacgccgcagucguggccgcuugcucccauggcaugguuaaacgacucgcagauuauucuagaacuaaggaacuggccaaagugcgggacgguuuuccugaucccgagaccggggagauugucgacccagcgauguuccagcagcuacacgcucauuuccccgauccuuggccacacuuuaggggagaacuggaggcccgccuccagcuggacgauagcgcagaacuucgugcccaauuggagauguucggcacauacccggcugaagcccuggagaccuuaagaccccucuuugugucacgggcaccucagaggcgcaacgguggcgcugcccacaaggagacuaucuacgcgcagccagaacgacugaaagagcaagggggaguaacgcagaaggugagucuugccucccugaagcccacagacaucgauaaacuaauugacccucauagaaaugaaaagcucuaugcagcuauacgggccaggcuggaggcucacggcgggaaaagcgauaaggcauucccagccgacaaccccuugcgcaaaccggauagagacggaaauccuaccggcccaaucguuagggccgucacuauggugauugacaagcugucugguauccagauacgugggggaauugcuaagaacgauaccauguuacggguggacgucuuucgccauaaaaaggauggcaaauuccaccucguuccccuguacgugcaucacgcgguggcacaggaacuuccuaaucgagccaucguagcuuuuaaggacgaggaugaguggacacugaucgacgauaacuuccacuuuuuguucucauuucaucccaaugacuucauuagaaucacccagaaaaacaaggccccaauucucgguuauuacgcaaguugucacaggggcacugggaaucugaaccuaugggcccaugaucggaaccaaaaagucggaaaggacggccagauagaagggaucggagugaagacagcuguugcgcuggagaaauuucacguggauguccuuggcaauauuuauccugcacccccagaacagcgccauggucucgccuga

SEQ ID NO: 2792 - RNA, 3366 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauuugguaaggcggacaaaccgccaaggacgacguuuaacuagaaggaagaaacaucggcgcgugagacugaauaggcuauuugaggaaucaggccucauuacggacuucaccaagaucaguauaaaccugaauccuuaccagcuucgggucaaaggucugacagaugaguugagcaacgaagaacucuuuaucgcccugaagaauauggugaagcaccgcgggauuuccuaucuggacgaugcgucugacgauggaaacucgucaguuggcgacuacgcucagaucgugaaagagaauagcaagcagcucgaaacuaaaaccccaggccaaauucaguuagagcgauaucagacauacgggcagcugagaggagauuucaccgucgaaaaggacgguaaaaagcauaggcuuaucaacguguuuccgacuagcgccuaucgguccgaggcauugcguauacugcaaacacagcaggaguucaauccccagauuaccgaugaauuuaucaaccgcuaccuagagauucucacgggcaagagaaaauauuaccacgggccuggaaaugaaaagucuaggacugacuacggccgguaucgaaccagcggugagacacuggauaacaucuucgggauccuuauuggaaaaugcacuuuuuacccagacgaguuccgcgccgcuaaggcauccuauaccgcccaagaguuuaaccuguugaaugaccucaacaaucugacaguacccaccgagacgaaaaaguuaucaaaagaacagaagaaccagauaaucaauuacguuaagaacgagaaagcuaugggcccugccaagcuguucaaauauauugcgaagcuccuuaguugugauguggcagacaucaaaggcuacagaauagauaagagcgggaaggccgaaauucauacuuuugaggcuuauaggaaaaugaagacacuggaaaccuuggacaucgagcaaauggaucgggagacucuagacaaacuggccuacguccucacacugaauaccgaacgcgagggaauccaggaagcacuugagcacgaguucgcugaugguucuuucucccagaaacagguggacgaacuggugcaauuuagaaaagccaacucaagcauuuucggcaagggguggcacaauuuuagugucaaguugaugauggagcucaucccagaacuguacgagacgucugaggaacagaugaccauuuuaacaaggcugggaaaacagaagacuaccuccagcucgaacaaaacaaaguauauagaugagaaacuacucacugaagagaucuacaaucccguuguggcgaagucuguacgucaggccauuaagaucgugaacgcagcuaucaaagaauauggcgacuucgauaauauugucauagagauggcccgggaaaccaacgaggacgacgagaagaaagcuauccaaaagauucagaaagccaauaaggaugaaaaagacgcagccaugcugaaggcugcgaaccaguacaacgguaaggcagagcuuccucauuccguguuucacgggcauaaacaguuggccacaaagauccgacuguggcaccaacagggcgaaagaugccucuauaccggaaaaacuauuucaauccacgaucugauaaauaacaguaaucaguucgagguugaccauauccuuccacugagcauuacguuugaugacuccuuggcuaacaaggugcucgucuacgccacagcaaaucaggaaaaaggccaaaggaccccguaucaggcccuggauucuauggacgaugcuuggagcuuccgcgaguuaaaggccuuugugcgggagucaaagacucugaguaacaaaaagaaagaauaccuacucaccgaggaagacaucuccaaguucgauguaagaaagaaguuuauugagaggaaucugguugacacacgcuacgcaagccgagugguccuuaacgcguugcaggaacacuuccgggcucauaagaucgauaccaaagugucugucgugcgugggcaauuuacuucacagcugagaaggcacuggggaauagagaagacacgcgacacguaucaucaccacgccguugacgcacucauuaucgccgcuaguagccagcugaauuuauggaaaaagcagaaaaacacccugguguccuacucugaggaucaacuuuuggacauugaaacuggugagcucaucucggaugacgaauauaaggagagcguauucaaggcccccuaccagcauuucgucgauacacugaaauccaaggaguuugaagacucaauacuauucaguuaucagguggauucuaaauuuaaucggaagaucagcgacgcaaccauuuacgcuacaagacaggccaaaguuggcaaggauaaagcggacgagacuuaugugcuggggaagaucaaggauauuuacacccaagacggauacgaugccuucaugaaaaucuauaagaaagacaaguccaaauuucucauguacaggcacgacccucagacguucgaaaaggucauagagccaauucuggaaaacuaucccaauaagcagaucaacgagaaaggcaaggaggugccuuguaauccauuucuuaaauacaaggaggaacaugguuauauccgaaaauacucaaagaaggggaacggccccgaaauuaaaaguuugaaguauuacgauucuaaacugggaaaccacaucgacauuaccccgaaggauuccaauaacaaaguaguguuacagaguguuagcccuuggcgcgcugacgucuacuucaauaagacaacuggcaaguaugagauacucgggcugaaauacgcagaucuucaauuugaaaagggaaccgguacauauaaaaucucucaggagaaguacaacgacauuaaaaagaaggagggcguggauuccgacucagaguucaaauuuacucuguauaagaaugauuugcuccuggugaaagacaccgaaacgaaggaacagcaacuauuccgguuucugaguagaacaaugcccaaacagaagcacuacgucgagcucaaaccauaugauaagcagaaguucgaagggggagaggcccugaucaaaguucuuggcaacguggcuaauagcggucagugcaagaaaggguugggcaagucgaacauuuccaucuacaaagugaggaccgacguacugggaaaucaacauauaaucaagaacgagggcgacaagccuaaauuagauuucuga

SEQ ID NO: 2793 - RNA, 3366 nt, Artificial Sequence
  Cas9 variant
augaacggccuggugcucgggcuugacaucggaauugguagcgucggcguugggauacugaauaaggauaccggagagaucauucacgccaacuccagaaucuuccccgcugcaacagccgacaauaacgugguaaggcggucuucacgccagggccgacguuugaaucauaggaaaaagcacagaagugugcgguuaaaagaucuguuugaauacuaugaccuacucacugauuucagcaaggucuccauuaaccugaauccuuaccgccuuagaguggacggucugaaccaacaguugacgaaugaggaacucuuuaucgcgcugaaaaacauaguuaagaggcgggggaucucuuaucuggaugacgcuucggaggauggaggcgccgugucaagcgacuacggcaaggcagucgaagagaaucgcaaacucuuagccgagcagaccccagggcagauucaacuggaacgauucgagaaguauggacaggugagaggugauuuuacaguaguugaaaacggcgagaaaaggcggcuuaucaauguguucaguacuuccgcuuacaagaaagaggcagaacguauuuugcgcaagcagcaggaguauaacaaucaaaucauggacgaauuuauagccgauuaccugaccauucuaacagggaagagaaaauacuaucauggaccgggcaacgagaagucuaggaccgacuacggucgguuccgaacugacgggacaacccucgauaacaucuuuggcauucugaucggaaaaugcacguucuaucccgaagaguaccgcgcuagcaaggccuccuauacugcgcaggaguuuaaucuucugaacgacuugaauaaccucaccgucccuacagaaacuaaaaagcugucagaggaacagaaaaagaccaucguggaguacgcaaagagugccaaaacauuaggcgcuagcacccugcucaaguauauugccaaaaugauagaugcaucuguggaccagaucagaggguacagggucgauguuaauaacaagccagaaaugcacacguucgagguguaccggaaaaugcaacuucuggagacuauucccguaggagaauuuucccgcgagguguuggacgaacuagcucauauccugacacucaauaccgagagagaagguauagaggaggccauuaacacuaagcugauggaugucuucucacaggaccagauccuugaacuggugcaauucaggaagaauaacagcaguuuguuuucuaaaggcuggcacaauuucucccucaagcugaugaucgaguuaauuccugaacuguaugagacaagcgaggaacagauggcgauccuaacccgucucgggaaacagaaguuuaaagagacgucgaagcggaccaaguacauugaugaacaggagguuacagaagagauauauaacccaguggucgccaaaucugugcgacaagcaaucaagauuaucaaugaggcuacuaaaaaguacggaaucuucgacaacauuguaauagaaauggccagagagaauaacgaagaggaagcuaaaaaggauuauaucaagaggcagaaagccaaccacgacgagaagaaugcagccauggagaaagcugcguuucaguacaacggcgaaaaggagcugcccgacuccauuuuccauggucacaaagaacuugcaaccaagguucgcuuguggcaucagcaaggggagaaaugucuguauacaggcaagaauaucccuauuucagaucucauccacaaccaguacaaguacgaaauagaccacauccugccacuuagucugagcuuugaugacuccuugucuaauaaagugcucguccuggccacugcuaaccaggagaagggacggagaaccccguuccaggccuuagauagcauggacgaugcauggucauauagggaguuuaaaaguuacgugaaggacuccaaaagccugggcaauaagaagaaagauuaucuacucacagaagaggacauuucuaagaucgaagucaaacaaaaguucauugagcgcaaccugguggauacccgauacucaagucggguugugcuuaauacuuugcaggacuuuuauaaagcccauaaguucgauacgacaaucagcguaguccgugggcaguuuaccucccagcugagaaggaaguggggacucgagaaaucucgcgaaacuuaccaccaucacgcuguggacgcccugauaauugcagcgucgagccaauuacggcuguggaagaaacagaacaauccccuuaucuccuauaaggagggucaguucguugacucagaaaccggcgagauuaucaguuugacagaugacgaauacaaagagcucguguucaaggcuccuuacgaucauuuugucgacacccugagaucuaagaaauucgaggauagcauacuauuuuccuaucaaguggacucaaaguucaacaggaaaaucagcgaugccacuauuuacgcaacacgaaaggccaaacuggacaaggauaaaucugaagagacguauguacucgggaagaucaaggacauuuacucccagaguggauaugaugcuuuuaucaaaauauacaauaaggacaaaagcaaguuccugauguaucacaaagauccacagaccuuugaaaaggugauugaggaaauccuucgcacuuaccccucuaaggaguucaacgagaaaaauaaggaaguuuccugcaacccuuuugagaaauacaagcaggaaaacggcccaauccggaaauauucaaagaaggguaaugggcccgagauuaaaaguuugaaguacuaugacaaaaacaucccggagagcuucauuaauauaacaccuucgaacuccaagaauaaagucauccugagacaauuaaaccccuggaggaccgacguguacuuuaaucaccagacagagaaguaugagcuccugggccuuaaguacgccgaucugcaguucgagaaaaagacuggaaccuauucuauuacgaucgacaaauacaacgaaauuaaggaaaaagagggcgugagcgagcauucagaauuuaaguucaccuuguacaagaaugaucuccugcuaaucaaagacacagagauaaaggaagaacagaucuuccguuuucugagucgcacuaugccaaaccaaaaacacuaugucgaacucaagccuuacuauaaagggaauuucgagggaaaggagcggauuaaaguuuuuaacaccacauccaaugguagaugucugaagggccuuaggaagaaaggguugucuaucuacaagauuaaaacugaugugcugggaaacaagcauuucaucaaaaaggaaggcgagaagcccaaauuaaaguuuuga

SEQ ID NO: 2794 - RNA, 3369 nt, Artificial Sequence
  Cas9 variant
augaacggcaagauccuggggcucgacauuggaguggccagcgucgguguuggcauacuugauaaaaagaccggggaaaucauucacgcuuccucuagaaucuuccccgcagccacagcggacucaaauguggaaaggcggggauuucgccagggccgacgucuggguagaaggaaaaagcaucggaaaguacgcuuggcugauuuauucagugacacugggcugauuacggauuuuagcaagguguccaucaaccuaaauccuuacgagcucagaauaaagggacugaacgaaaaacuuaccaaugaggaacuguucaucgccuugaagaacauugucaaaaggcggggcaucucuuaucucgacgaugcaaaugaggacggcgagucgucaagcagugaauacgggaaggccguggaggaaaaccgcaaacugcuggcugauaagacaccaggacaaauucagcucgagcgauuugagaaguauggucagguuagaggcgacuucacuaucgaagagaauggggaaaaacacagguuacugaacguguuuuccaccucugcauacaagaaagaggccgaacggauacuuacaaagcagcaagauuauaaucaggacauuaccgaugaguucauccaggcuuacuugacuauucugacaggaaaacguaaguauuaccauggcccggguaacgagaaaagccgcaccgacuacgggagauuuaggacggacggaacuacccuagauaauaucuucggcauccucauuggcaagugcacauuuuaucccgaagaguaccgggccgcgaaggcauccuauacugcccaggaguucaaccugcuuaaugaccugaacaacuugaccgucccuacagagaccaaaaagcucucagaagaacaaaaacgacagauaaucgaguacgcuaagggggccaaaacgcugggagcagcuacuuuacugaaguauauugccaagcucguggaugguaguguagaagacaucaaaggcuaccgcauagauaagagcgagaaaccagaaaugcacacauuugacauuuauagaaagaugcagacccuugagacuguugauguggaaaaacugucuagggaggucuuggacgagcuagcgcauauccugacacucaauaccgaacgggaggggaucgaagaggccauuaagguguccuucaucaagcgcgaguucgaacaggaucaaauugcagagcuggugucauuuagaaaaagcaacaguucucuuuucggaaagggcuggcacaauuuuuccauaaaacugaugacggaauugauccccgagcucuacgaaaccagcgaggagcagaugacaauucugacuagguuagguaagcagaaaaccaaggcucguucgaagcggacaaaauacaucgacgaaaaggagcugacugaugaaaucuauaacccugucguugccaaaucugugcgacaagcuauuaagauaaucaaucuagccaccaaaaaguacgggguauucgacaacauugugaucgagauggcaagagaaaauaacgaggaggacgccaaaaaggauuaugucaagaggcagaaagcuaaugaagacgagaagaacgcggcaauggaaaaagccgcucaccaguacaauggcaagaaagagcucccagauaacguguuucauggacacaaggaacuggccacaaagauucgccuuuggcaucagcaaggcgagaaauguuuguauaccgggaagaauauccccauauccgaccugauccacaaccaguacaaauaugagauugaucacauccucccucugucacuuaguuucgacgauagccuggcaaauaagguuuuggugcucgccacugcuaaccaggaaaaaggacagcggacgccauuucaagcccuggacuccauggaugacgcauggucuuacagagaguucaaggcguacgucaggggugcucgcgccuuaagcaacaagaaaaaggauuaucugcuaaaugaagaggacauuaacaaaaucgaggugaagcagaaauuuauagaacgaaaucucguagauacacgguacucaagucguguugugcugaacgcacuucaggacuucuauaaguugaaugacuuugauaccaagauuuccgucgugagaggccaguucacuagccaacugaggcgcaaauggcggaucgacaagucuagagagaccuaccaucaccaugccgucgaugcucucauuaucgccgcaucaagucagcugagguuauggaaaaagcaggggaacccgcugauaagcuauaaagaaaaucaguuuguggacuccgagacaggagaaaucauuucucuuaccgaugacgaguacaaggaguugguuuuccgagcucccuaugaucacuucguggacacuguaucgagcaaaaaguuugaagaucgcauccucuucuccuaccaagucgacucaaaguacaaccggaaaauuagugaugccacaaucuauucuacgagaaaggcgaaacugggcaaggacaaaagcgaggaaaccuacgugcuagguaagauaaaggauauuuauacucagacaggguacgacgccuuuaucaaacuguauaagaaagacaaguccaaauuccucauguaccauaaggauccuaucaccuuugagaagguuauugaagagauccugaaaacauauccagacaaggagauuaaugaaaaaggcaaggagguggcuugcaaccccuucgaaaaauacaggcaggagaauggaccucuucguaaguacucaaagaaaggcaaggggccagaaauaaagagcuugaaguauuacgauaacaaacugggaaaucacaucgacauuacucccgauaacucugagaaucaagucaucuuacagucccucaagccguggcgcaccgacguguauuuuaaccacaagacgaaaauuuacgagcugaugggucuuaaguauagugaucugagcuucgaaaaaggcucugggaaguaccggaucuccuuggacaaauauaacguaauaaagaaaaaggagggagugcauaaggaaucagaguuuaaauucacccucuacaagaaugaucugauccuaauuaaagaccuggagaagagugaacagcagcucuuuagauacaacagcaggaaugauacaucgaaacacuauguugagcugaagccuuacgacaaggcaaaauucgaaggcaaccaaccccuuauggccuuguuugguaaugucgcuaaagggggccagugucugaaaggauuaaacaaggccaauaucuccauuuauaaagugcagacugacgugcucggcaacaagcgauucaucaagaaagagggggaugcaccaaagcuggaguucuga

SEQ ID NO: 2795 - RNA, 3369 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauuugguaaggcggacaaaccgccaaggacgacguuuaacuagaaggaagaaacaucggauugugcgccugaauagacuauuugaggaaucaggccucaucacggacuucaccaagauaaguaucaaccugaauccuuaccagcuuagggucaaaggucugacagaugaguugagcaacgaagaacucuuuauugcccugaagaauauggugaagcaccgggggaucuccuaucuggacgaugcgucugacgauggaaacucgucaguuggcgacuacgcucagauugugaaagagaauagcaagcagcucgaaacuaaaaccccaggccaaauccaguuagagcgcuaucagacauacgggcagcugcgaggagauuucaccgucgaaaaggacgguaaaaagcauagacuuauaaacguguuuccgacaagugccuauagguccgaggcauugcggauucugcaaacucagcaggaguucaauucucagaucaccgaugaauuuauuaaccguuaccuagagauccucacgggcaagcgcaaauauuaccacgggcccggaaaugaaaagagcagaacugacuacggcagguaucggaccaacggugagacacuggauaacaucuucgggauucuuauaggaaaaugcacuuuuuacccugacgaguuccgagccgcuaaggcauccuauaccgcccaagaguuuaaucuguugaacgaccucaauaaccugacaguaccaaccgagacgaaaaaguuaucaaaagaacagaagaaucagaucauuaacuacguuaagaaugagaaagugaugggccccgcuaagcuguucaaauauaucgccaagcuccuuaguugugaugucgcggacauaaaaggccaucgcauugauaagagcgggaaggcagaaauccacacuuuugaggccuacagaaaaaugaagacacuggaaaccuuggacaucgagcaaauggauagggagacucuagacaaacuggcuuaugugcucacacugaacaccgaacgggaggguauucaggaagcccuugagcacgaguucgcagauggaucuuucucccagaaacagguggacgaacugguccaauuucgcaaggcuaauucaagcaucuucggcaagggguggcauaacuuuaguguuaaguugaugauggagcucauuccugaacuguacgagacgucugaggaacagaugaccauauuaacaagacugggaaaacagaagacuaccuccagcucgaauaaaacaaaguacaucgaugagaaacuacucacugaagagauuuauaacccagugguagccaagucugugaggcaggcgaucaagaucgucaaugccgcaauuaaagaauacggcgacuucgauaacauagugaucgagauggcucgugaaaccaaugaggacgacgagaagaaagccauucaaaagauccagaaagcuaacaaggaugaaaaagacgccgcaaugcugaaggccgcuaaccaguauaaugguaaggcggagcuuccccacuccguuuuucaugggcacaaacaguuggcaacaaagauucggcuguggcaccaacagggcgaacgaugccucuacaccggaaaaacuaucucaauacaugaucugaucaacaauccuaaccaguucgagguggaccacauucuuccacugaguaucacguuugaugacagcuuggccaauaagguccucguguaugcuacagccaaccaggaaaaaggccaaagaaccccguaccaggcacuggauuccauggacgaugccuggucuuucagggaguuaaaggcuuuuguacgcgagagcaagacucugucaaauaaaaagaaagaauaucuacucaccgaggaagacauuaguaaguucgauguucggaaaaaguuuaucgagagaaaccugguggacacaagguacgccucccgcgucgugcuuaaugcauugcaggaacauuuccgagcgcacaagauagauaccaaagucagcgugguucgggggcaauuuacuucucagcugcguagacauuggggaauugagaagacaagggacacguaccaccaccaugcuguggacgcccucaucauugcagccucaagucagcugaacuuauggaaaaagcagaaaaauacccugguaagcuauuccgaggaacaacuuuuggauaucgagacuggugaacucauaucugacgaugaguacaaggagucggucuucaaggcucccuaucagcacuucguggacacacugaaaagcaaggaauuugaggauuccauccuauucucauaccagguugacaguaaauuuaaccgcaagauuucugaugccaccaucuaugcaacacggcaggcuaaagugggcaaggacaaaaaggaugaaacuuacguccuggggaagauuaaagacaucuauacccaagauggauacgacgccuucaugaagauauacaaaaaggauaaaagcaaguuucucauguauagacaugacccucagacguucgagaaggugauugaaccaauccuggagaauuaccccaacaaagagaugaaugaaaagggcaaagagguaccuuguaacccauuucuuaaguauaaagaggaacacgguuacaucaggaaguauuccaagaaagggaacggccccgaaauuaagucauugaaauacuaugacagcaagcuguuaggaaauccgaucgauauuaccccugagaacucuaaaaauaaggugguucuccagucccugaagcccuggcgaacagacgucuacuucaacaaaaauacuggcaaguacgagauacuugggcugaaauaugcggauuugcaguuugaaaagaaaaccggaacauacaagaucagucaagagaaguauaacgguauuaugaaagaagagggcguggacagcgauucugaguucaaguuuacucucuacaaaaaugaccugcuacuggugaaggauaccgaaacgaaagagcagcaacucuuccgcuuucugucccggacaaugccaaacgucaaguauuacguugaacuuaaaccuuauucaaaggacaaguucgagaaaaaugaaaguuugaucgagauucuggggagcgccgauaagucgggaagaugcaucaaaggcuuagguaaguccaacauaucuaucuacaaagugaggaccgacgugcucgggaaucagcacauuaucaagaacgagggcgauaagcccaaacuggacuucuga

SEQ ID NO: 2796 - RNA, 3369 nt, Artificial Sequence
  Cas9 variant
augagcaacggcaagauccuggggcucgacauuggaauagccuccgugggugucggcguuaucgaugcucagaccggggagauuauccacgcaucuucaagaauuuuccccagugccaaugcggcuaacaaugccgaaaggcggacauuucgcggaagccgacgucuuaucagaaggaaaaagcaucggauaaaacgccuggacgauuuguucaacgacuuucacaucaauuuagauggcgagauguccacugacaacccuuacgugcugagaguaaagggucuaucucaaaaacucacgguggaagaacuguauauuucgaucaagaauauuaugaagaggcgggggaucucauaccuugaugacgcagaaagcgauaacgaggccggacgcagugacuaugcuaaagcaauagagcgaaauagacagcuguugaccuccaagacaccaggcgaaauucagcucgagaggcuggaaaaauacggccagcugcgggggaacuucacuaucauugaugaggagggacaaucucagcagaucaucaaugucuuuagcaccuccgacuaugugaaggaaguugagaaaauucucgauugccagaagauguaccauaaguucauaucagacgaauuuugugacaaauuaaucgagcugcuucgugaaaagcgcaaauauuacguggguccgggcaacgagaagaguagaacagauuacgggauuuauaggaccgacggaacuacauuggagaaucuguucggcauccuaauagguaaaugcaccuuuuaccccgaucaauaucggagcucucgagccuccuacacggcucaggaguucaacuuucucaaugaccugaacaaccuuacugucccuaccgagacaaagaaacugucacaggaacagaaggaguucuuggugaauuaugccaaggaaacuagcguacucggggcgggaaaaauucugcaacagaucgcaaaguuagccgauuguaaaguugaggacauccgcggcuacagacuggauaacaaggacaaaccagagcuccacauuuuugaaaccuauagggcuaugaagggccuugugccccuggucgauaucgggguguugagucgggagcagcuagacauucuggccgauauacucacacugaauaccgacuucgaaggaauccgcgaggcacuuaagaaacaacugccuaacguguucgacgaaaagcaggucaaagguuuggcuucuuuuagaaaguccaaaagccaacucuucgccaagggcuggcauaaucugucgcagaagauuauguuagagguuaucccagagcuguacgcgacgucugaugaacagaugacuauccuaacaaggcucgggaaauuugagaaguccucaguggccgaauaccccaguagcauuaacguagacgagauaaccgaugagaucuauaauccuguggucgcaaaauccauucgucagacuaucaagauuaucaacgcuucuaucaaaaaguggggagaguucgaccagauagugauugagaugccacgggaucgaaaugaagacgaggaaaagaaaagaaucgccgauggccagaaggcuaacgccaaagagaaggcagacagcauucugagggccgcugagcuuuacugcgcggguaaaguuuugccggauuauguguacaaugggcacaaccaacuggcaacaaagauccgccucugguaucagcagggcgaacgguguauauacaccggacagcccauuucaauccacgaccugauucauaaucaaaaccaguaugagaucgaucacauacuuccucugaguuugacguuugacgauucccucagcaauaaaguccugguguuagccaccgcuaaccaggaaaaggcccagagaacaccauacaacuaccugaagucugcaacuucagccuggaguuauagggaguucaaagacuacguaaccaagcgcaaaggcaucgggaagaaaaagugcgaauaucuaacauuugaggaggacauuaauggauucgaaguucgaagcaaguuuauccaacggaaccucguggauacucguuacgcuuccaaagucauucugaaugcccuucaggacuauuucaagaucucugguauacagaccaaagugucggucgugagaggccaauuuacaagccaguugaggcauaagugggggauugagaaaacccgcgaaacuuaccaccaccaugcaguugaugcgcugaucaucgcugccuccucacagcuccggcuguggaagaagcaggagagucccuuagugguagacuaucaagaaggaagacaggucgaucuggagacgggcgagauucuugaauugacagacgagcaguacaaagaacucguguaccagccuccauaucaagguuucguuaacaccaucucuagcuccgcauuugauaaugagauucuguucucauaccagguggacagcaaggucaacaggaaaauaucugaugccacuaucuaugcuacccgaaaugcccagcuagggaaggacaaaacagagggcauuuacgugcugggaaagaucaaggauauuuauacccaggcaggcuacgaggcuuuccucaaacgcuauacuaaggacaaaacauccuuucugauguaccacaaggaucuugacacgugggaaaaaguaaucgaaauaaucuugcgggacuacagagaguaugaugaaaaggggaaagagauuggaaaccccuucgagagguaccgucgcgaaaaugguuaugugaagaaguacagucggaaaggcaacgggaccgccaucaagagccugaaauauuacgacaauaaguuaggaaaccauauugauaucacuccggaaaauucuagaaacgcgguuguccuccaaucccugaaaccuuggaggacagacguguauuuuaauaaggaaaccggcaaguacgaguuccuugguauaaaauacucagaucugaguuuugaaaaggggacaggcgaguauggaauuagccaggagaaauacgacucgaucaagaucgccgaaggcguggcuaaaaaguccauuuucaaguuuacuuuguauaaacaggaucuccuguucauaaaggacaucgagaacaacuuugggaaacuacugcgauucaccucuaagaaugauacgagcaaacacuacgucgaacucaagcccuaugacaagaacaaauuuggaaccgaggaaccacugcuuccuguuuugggcaauguggcaaagucaggucaauguauuaaagggcugaacaagaguaauaucuccauuuacaaagugcggacagauaucuuaggauaucgccauuucauaaagcaggagggcgagcacccccagcucaaguuuaaaaaguga

SEQ ID NO: 2797 - RNA, 3369 nt, Artificial Sequence
  Cas9 variant
augagcaacggcaagauccuggggcucgacauuggaauagccuccgugggugucggcguuaucgaugcucagaccggggagauuauccacgcaucuucaagaauuuuccccagugccaaugcggcuaacaaugccgaaaggcggacauuucgcggaagccgacgucuuaucagaaggaaaaagcaucggauaaaacgccuggacgauuuguucaacgacuuucacaucaauuuagauggcgagauguccacugacaacccuuacgugcugagaguaaagggucuaucucaaaaacucacgguggaagaacuguauauuucgaucaagaauauuaugaagaggcgggggaucucauaccuugaugacgcagaaagcgauaacgaggccggacgcagugacuaugcuaaagcaauagagcgaaauagacagcuguugaccuccaagacaccaggcgaaauucagcucgagaggcuggaaaaauacggccagcugcgggggaacuucacuaucauugaugaggagggacaaucucagcagaucaucaaugucuuuagcaccuccgacuaugugaaggaaguugagaaaauucucgauugccagaagauguaccauaaguucauaucagacgaauuuugugacaaauuaaucgagcugcuucgugaaaagcgcaaauauuacguggguccgggcaacgagaagaguagaacagauuacgggauuuauaggaccgacggaacuacauuggagaaucuguucggcauccuaauagguaaaugcaccuuuuaccccgaucaauaucggagcucucgagccuccuacacggcucaggaguucaacuuucucaaugaccugaacaaccuuacugucccuaccgagacaaagaaacugucacaggaacagaaggaguucuuggugaauuaugccaaggaaacuagcguacucggggcgggaaaaauucugcaacagaucgcaaaguuagccgauuguaaaguugaggacauccgcggcuacagacuggauaacaaggacaaaccagagcuccacaccuuugaaacauauagggcuaugaagggccuugugccccuggucgauauugggguguugagucgggagcagcuagacauccuggccgauauucucacccugaauacggacuucgaaggaauacgcgaggcacuuaagaaacaacugccuaacguguucgacgaaaagcaggucaaagguuuggcuucuuuuagaaaguccaaaagccaacucuucgccaagggcuggcauaaucugucgcagaagaucauguuagagguuauuccagagcuguacgcgacuucugaugaacagaugacaauccuaaccaggcucgggaaauuugagaaguccucaguggccgaauaccccaguagcaucaacguagacgagauuacugaugagauauauaauccuguggucgcaaaauccauccgucagacaauuaagaucauuaacgcuucuaucaaaaaguggggagaguucgaccagauagugaucgagaugccacgggaucgaaaugaagacgaggaaaagaaaagaauugccgauggccagaaggcuaacgccaaagagaaggcagacagcauccugagggccgcugagcuuuacugcgcggguaaaguuuugccggauuauguguacaaugggcacaaccaacuggcaaccaagauucgccucugguaucagcagggcgaacgguguaucuacacgggacagcccauaucaauucacgaccugauccauaaucaaaaccaguaugagauugaucacauccuuccucugaguuugaccuuugacgauucccucagcaauaaaguccugguguuagccacagcuaaccaggaaaaggcccagagaacuccauacaacuaccugaagucugcaaccucagccuggaguuauagggaguucaaagacuacguaacaaagcgcaaaggcauagggaagaaaaagugcgaauaucuaacuuuugaggaggacaucaauggauucgaaguucgaagcaaguuuauucaacggaaccucguggauacccguuacgcuuccaaagucauccugaaugcccuucaggacuauuucaagauuucugguauccagacaaaagugucggucgugagaggccaauuuaccagccaguugaggcauaagugggggauagagaaaacucgcgaaacguaccaccaccaugcaguugaugcgcugauuaucgcugccuccucacagcuccggcuguggaagaagcaggagagucccuuagugguagacuaucaagaaggaagacaggucgaucuggagacaggcgagauccuugaauugaccgacgagcaguacaaagaacucguguaccagccuccauaucaagguuucguuaacacuauuucuagcuccgcauuugauaaugagauccuguucucauaccagguggacagcaaggucaacaggaaaauuucugaugccaccauauaugcuacacgaaaugcccagcuagggaaggacaaaaccgagggcaucuacgugcugggaaagauuaaggauaucuauacucaggcaggcuacgaggcuuuccucaaacgcuauacaaaggacaaaacguccuuucugauguaccacaaggaucuugacaccugggaaaaaguaauugaaaucauauugcgggacuacagagaguaugaugaaaaggggaaagagaucggaaaccccuucgagagguaccgucgcgaaaaugguuaugugaagaaguacagucggaaaggcaacgggacugccauuaagagccugaaauauuacgacaauaaguuaggaaaccauaucgauauuacaccggaaaauucuagaaacgcgguuguccuccaaucccugaaaccuuggaggaccgacguguauuuuaauaaggaaacaggcaaguacgaguuccuugguaucaaauacucagaucugaguuuugaaaaggggacuggcgaguauggaauaagccaggagaaauacgacucgauuaagaucgccgaaggcguggcuaaaaaguccaucuucaaguuuaccuuguauaaacaggaucuccuguucauuaaggacauagagaacaacuuugggaaacuacugcgauucacgucuaagaaugauaccagcaaacacuacgucgaacucaagcccuaugacaagaacaaauuuggaacagaggaaccacugcuuccuguuuugggcaauguggcaaagucaggucaauguaucaaagggcugaacaagaguaauauuuccaucuacaaagugcggacugauauuuuaggauaucgccauuucaucaagcaggagggcgagcacccccagcucaaguuuaaaaaguga

SEQ ID NO: 2798 - RNA, 3372 nt, Artificial Sequence
  Cas9 variant
auggccaagauccugggccucgaccuugggaccaacagcauuggaugggcucugauagaugacgugcagaauaaaaucuugggugucggcuccagaauuuuccccauggggguugagaacuuaggagauggcgacggugaaaucucuaagaaugcaucaaggacagggacucggggagugcgccgacaauuuuuccguagaaggcugcggaaaaagguacuacucaaagcccugagugagaacaauaugugcccuaugauuacgagcgauuuugacaacuggaagaagaccaaacaguucccauccgaaaaacuugcgucuugguuugcucugaauccguacgaguugcgcaacaaagcccucucggaaaagcugacacuggaggagaucggcagaauauucuaucaccucauccagaggcggggcuuuuuaucaaauagccgcaaagggggaacugaugacggugcaauuuucaagggcaaccccaaggaagggaaaaucggaauuaccgauacacaggagaguauccaagacaagacccugggcuccuaccuuuuugaaauauauccuaaagagaaucagccauuccagaacgguuuggagcgaauuagaaauagguacacugugcggaagauguaugucgaugaauuugagaugaucugggaaaaacaggcccaauacuauucuaaccugaaugaggaccuaaagacacucuucgggggacguaaacuggauggcuacaaggaagacggcauucuuuuucaucagcgcccccugagaagccagaagcacuugguggggaacuguguuuucgagccuaacaaaaccaagugcccaaucuccgcuauccccuucgagcaguuuaggguguggcaaugggucaauacgguggaauacaacggaaagaagauuucacagguagagaaagaaaagauaguugaguuccucuaugcaaaugacaagacugauuuuaaaaagauccggaaagccauugguaaggaaaguaccgaguucaaauuuaacuacaaggacgaugacaagaucgugggcacauauacugucagccaucugucuaauaaaaaguacuucgggaaaaagugguuugaguucuccgaaaaagagcaggaagauauauggcacauuuuauacuuuuucgacucaaagagcaaccugaaggaguaugcuaucaaaaauuggaacuuuaccgaggaacaagccgagaguaucgcgaaguucaaugugaaagauggauauucuucccucagccgaaaggcaauuucgaacauccuuccuuuucugaaauugggcuucacauacgacguggccgucguucuaggugggauuaagaauguguucggccaugaaugggagaaacugucugaugaaaagcgcaacuuucucauagacaauguagagggaaucgugagauccaagaccaaaggcggguucauugaugucaucaaggacauccugaggaacgacuacaauauuucagauaaccagcuucggaaacuguaucaccacagugcuacgauauacguggccgaguugcucgaaaagcugccaguuggaaaagaggcagacaaggaaauccagagcauucgcaacccgaucgugauuacugcuuuauuugagcugagaaagcuagucaaugaacucaucgaugacuucgguuccauagaugagaucaaaguggagauggccagggaccugaagauuucuaaaagccagcguaacaagauccggcgagaacaaaagagacuugagagggaaaaugaucgcguaaaggcgcgguugcuggaggaaggccagagaauuacacaugacaacauccuccuguauaaacuuugggaggaguguaaaaagaccugccccuacacugggaauccuauaccacuguauaaauuguuuacaggagaaauucagaucgagcacauucaucccuggucaaggagucucaacgauuccuucgccaauaagacccuguguuacgcagacgaaaaccgcaaaaagggcgauaagacgccuuaugaguuuuacgguaaugacgaaagcaacuggucugcuaucaaagagcgagccuuaaagcuguucucagauaccaaagaguacccaaaugcuuaucagaaguuuaaacgguucguucaacacaaguuugacgacgauuucaguagccgucagcuaaacgacacaagauacauauccaaagaagccaagaauuaucucucuaagaucugcaaaaagguggcagucucgcccgggcaggccacuagcaaccugaggcagaaauggggcaugaauaacauucuuaacgaugagaaugaaaagacccgcgaggaccaccggcaucacgcuaucgaugcguuggugauggcauguacaaaaauuuccuacguccaagagcugucaaaguggaacagauauaauaggaacgccgaacucaagaaauuuccgcugccuugggagacuuucuggagugacgcuaaucgagccguggauaagaucuuaauaucucauaaaaagguuagcaacgacauuaccggacgcacacacaucuccgagaaaaauggcaagaaguacaaaaacguggggguagcagcccggggacagcugcauaaggaaaccgucuaugguaaaagaacuuucaauggcgaagaggcuuuucacgugaggaagacgaucgauucacuuacaaccgagaaacaguuggaaaagguuguggacgagagcauuaagcuccugaucaaaaagcguguccaggaacuagggggauucgugaaaggcgccauucccgcaaacaccuuuuucguaguggaugagaaugguauaaagcaaccacagaucuuucugccuaacaaaaauggggcgcccguuccaguccucaaggugcgcaugaaggaaaacauuggcggagcugagaaacugaaggagaaugugaaccagugggucaacccccggaauaaccaccauguucuuaucuacaaagacgaaaagggcaauuugaaagaggaaguggugacuuucuggacaguagucgagagaaagaggaccgggcaaucugccuaccagcugccuuuugauggaaaagaaauugugacuacauuacacaucaacgacauguuccuccugggccuuaaugaggaggaaauaaacugggagaauccagacuaugaaguucugaaggagcauuuguaccgagugcagaaguuuacguccggugauuauuacuuccggaucgcaaaaaccaguagcauucagaacgccaucgagaagcaacagauuaauucuuuuggguucggcaaaaacggaugguccacucacaauccgaucaaggucaaaauaucagugagugguaagauuagcaagguuuga

SEQ ID NO: 2799 - RNA, 3372 nt, Artificial Sequence
  Cas9 variant
augaacggccuggugcucgggcuugacaucggaauugguagcgucggcguugggauacugaauaaggauaccggagagaucauucacacaaacuccagaaucuuccccgccgcuacugcagacaauaacguggaaaggcggaauagucgccaggcccgacguuugaacagaaggaaaaagcaucggggcgcgcgcuuacacgaucuguuugaggacuacgaucuacucauugacuucucaaaaguaaguaucaaucugaacccuuauagacuuagggugcaaggucuggauaauccauugacgaccgaagaacucuuuauagcucugaagaacaucgucaaacggcgcgggauuagcuaccuggacgaugccuccgaaaauggaggcgcagugucuucggacuauggcaaggccguugaggagaaccgaaagcucuuagcugaacagacaccggggcagauccagcuggagagauucgaaaaauacggacaagugaggggugauuuuacugucgaggagaagggcgacaaacaucggcuuauuaauguguucucaaccagcgcauaucguaaggaagccgagcgcaucuugagaaaacagcaggaauuuaacaaucagauaacagauaaguucauugaggacuaccugaagauccuaaccgagaaaaggaaguauuaccacgggcccggaaacgagaaaagucggacugacuacggccgauuucgcacagaugguaccacgcucgacaacauuuucgggauccugaucggaaagugcacuuuuuauccuaaugaguacagagcuuccaaagccucuuauaccgcgcaagaguucaaccuucugaaugauuugaacaaucucacaguaccaacugagaccaagaaacugagcgaggaacagaagaagacaauuguugaauacgcaaaauccgccaagaccuuaggcgcuucaacgcugcucaaauauauagccaagaugaucgacgcaaguguggaucagauuaggggcuaccgggucgacgugaacaauaaacccgagaugcauacuuuugagguguaucgcaagaugcagagccuugaaacaaucccugucggggaguucucuagagaaguucuggaugaguuggcucacauacuaacccugaacacugaaagggagggaauugaggaagccaucaauacaaagcucauggacguguucucccaagaucagauccuggagcuuguacaguuucguaaaaacaauucaagccuguucaguaaggguuggcacaacuuuucuuugaaacucaugauggaacugauuccagaguuauacgagaccuccgaggaacaaauggcgauccugacgcggcuaggcaagcagaaauucaaggaaaccagcaagcgaacaaaauacauugacgagaaggaagugacugaggagauauauaaucccgucguggccaaaucgguuagacaggcaaucaagauuaucaacgaagcuaccaaaaaguacgggaucuuugauaauauugugauagagauggccagggaaaacaacgaggaagacgcuaagaaagacuauaucaagcgccagaaagccaaucaugaugagaagaacgcagccauggagaaagcugcguuccaauacaauggaaagaaagaacucccugacucuauuuuucacggccauaaggagcuggcaacaaagauccggcuuuggcaccagcagggugaaaaauguuuguauacugggaagaacauuccaaucuccgaucugauacacaaucaguacaaauaugagaucgaccauauucucccgcugucacuuaguuucgaugacagccuguccaacaaggucuuggugcucgccaccgcuaaucaagaaaaaggccagagaacacccuuucaggcccuggauucuauggacgaugcauggagcuacagggaguucaagucauacguaaaggacaguaaauuacugggaaacaagaaaaaggauuaucuacucaccgaggaagacaucuccaaaauugagguuaagcagaaguuuaucgaacgcaaucugguggauacucgauacagcucucgggucgugcuuaacacguugcaagacuucuauaaagcccacaaguuugacacaaccauaucagucgugcguggccaguucacuucucagcugagaaggaaaugggggcucgaaaagagccgcgagaccuaccaucaccaugcuguugaugcccugauuaucgcagcguccucucaguuacggcuguggaaaaagcaagcuaauccucuuauuucguauaaggaagaccaguucguggauagcgagacaggagaaaucauauccuugaccgacgauaaauacaaggagcucguauuuaaagccccauaugcacacuucgucgacacucugucaaguaagaaauuugaagauucuauccuauucagcuaccagguggacuccaaguacaacagaaaaauuucagaugccacaaucuaugcuacgaggaagguuaagcuggacaaagauaagagcgaggagaccuacgugcucgguaaaauuaaggacaucuauucucaagccggcuacgaugcauuuauaaaaauuuauaauaaggacaaguccaaauuccugauguaccacaaggacccccagacuuuugaaaaagucaucgaggaaauccuucgaacauauccuaguaaggaguucaacgagaaaaauaaggaagugccaugcaaccccuuugagaaguaccgccaggaaaacgggccgauucggaaauacagcaagaaaggaaauggcccugagaucaagucuuugaaauauuacgauaagaacauucccgaauccuucauaaauaucaccccaucaaacaguaagaauaaaguaauucugagacaguuaaacccuuggaggacagacguguauuuuaaucaucaaacugagaaguacgaacuccugggucuuaaauaugcugaucugcaguucgagaagaaaaccgggacguacagcaucaccauugacaaguauaacgagaucaaggaaaaagagggcguuggagaacagucggaguuuaaguucacauuguacaaaaaugaucuccugcuaauaaaggacacuaaaaacaaugagaagcagaucuuccguuuucugucccgcaccaugcccaacgucaaacacuacguggaacucaagccauaugauaaggccaaauucgacggcaaucaaccccugauuacaaucuuugggaacguggcgaagggaggucagugucuuaaaggcuugaauaagucuaacauuagcaucuucaaagucaagacugauguucuggggaacaagcauuuuauaaccaaagagggagaaaagccuaaauuaaaguucuga

SEQ ID NO: 2800 - RNA, 3378 nt, Artificial Sequence
  Cas9 variant
augaacggccuggugcucgggcuugacaucggaauugccagcgucgguguuggcauacugaauaaggagaccggggaaaucauucacgugaacuccagaaucuuccccgcugcaacagccgauucuaauguagagaggcggggauuucgccagggccgacguuuggguagaaggaaaaagcaucggucagcgcgcuuaaacgaccuguucgaagaguuuggguucauuacugauuuuagugcugugccucuaaaucucaacccauacgcccugagagucaaaggacuuagcgaagaacugacgaaugaggaauuguucaucgcacucaagaacauaaucaaaaggcggggcauuuccuaucuggacgaugccucugaggacggcgaaaccgcuucgaaugaguacgggaaggcaguggaggaaaaccgcaagcugcucgccgauaaaacaccgggacaaauccaguuagagcgauuugaaaaguauggucagguuagaggcgacuucacuguggucgagaauggggaaaaccacaggcugauuaauguguuuucaaccagcgcuuacaaaaaggaggccgagcggauccuucgucgccagcaagaguucaacguaagaauaagugaugaguuuauugaagcguauuugacaauccugaccggaaaaaggaaguacuaucauggccccgguaaugagaagucccggacugacuacgggcgauuccgcacagauggaaccacgcuagacaacauuuuuggcauccucaucggcaaaugcacuuucuacccugaugaauauagagcagccaaggcuucuuacaccgcccaggaguucaaccugcuuaaugaccugaacaauuugacaguuccaacugagaccaaaaagcucaggcccgaacagaaacggcagauuguggaguaugcacgcacagcuaagacccuggggacgccuacuuuacugaaauacauagccaagcucgucgacggaagcaucgaugacauuaaggguuauagaaucgauaaauccgacaagccagaaaugcacacauuugaugcguacaggaaaaugcguacccuugagcugguggacguggauauauugucacgggaaacucuagacgaucuggccuauauucucacacugaacaccgagagugagggcauccuugaagcacugaauagcaagaugcccgggacguucaccaaagagcaaaucgacgaauugauucaguuucgaaagaagaacucugcugucuucggaaaaggcuggcauaauuuuucccucaagcugaugaacgaguuaaucccugagcuguacgaaacaucagaggaacagaugacuauucuaaccagacucgguaaacagaggagccgcgagauaaguaagcggacaaaauacaucgaugaaaaggagcugacugacgagauuuauaauccaguuguggccaagucuguaagacaagcuaucaaaaucauuaaccuugccaccaagaaauacgggauauucgacaauaucgugauugaaauggcaagggaguccaacgaagaugacgagaagaaagccauccagaauguccagaaggcuaacgaagaugagaagaaagcggcaauggagaaggccgcugacuuguauaauggcaaaaaggaacugccggauagcauuuuucacggacacaaagagcucgccacaaagauccgccuguggcaucaacagggcgaacgaugucuuuacaccgggaaaaacauaucgauccacgaccugauucauaacccccaccaguaugagaucgaucacauuuugccucucucucuguccuucgacgauggauuagcaaauaaggugcugguucuagccacugcuaaccaggaaaagggucaacggacgccauuucaggcccucgacucaauggaugacgcauggaguuacaucgaguucaaacaguaugugcguaauagcaagucccugucuaacaaaaagaaagauuaccuuuugacagaggaagacauaagcaagauugaggucaagcagaaauuuaucgaaagaaaucugguggacaccagguacucaagucgcguaguucucaacacucugcaagaguucuauaagaccaaugauuuugacacaaaaauuuccgugguccggggccaguucaccagccaguuaagaaggaaguggaaaaucgagaagucucgagauacuuaccaucaccaugcgguggacgcucugauaaucgccgcaucaagucagcuucgcuuguggaagaaacaaaacaauccccucauuagcuaucgggaagggcagcuggucgauccugagacaggagaaauccuaucccugacggacgaugaguacaaggaacucgugcugagaccacccuaugacuacuucguugauacccuuaaaucuaagucguuugaggacagcauuuuguucuccuaucagguggauucaaaauacaacaggaagaucagugacgccacuauauacggcacacguaaggcucagcuggguaaagauaagcaagaggaaaccuauguauuagggaaaauuaaggacaucuacucucagaaaggcuaugaggacuuuaucaagcgcuacaaaaaggauacaacucaguuccucauguaucacaaggacccgcaaaccuuugccaaagucauugaagagauccugaagacguacccugauaaagaacuuaaugagaagggaaaagagauucccugcaacccauucgaaaaguaucggcaggagaauggcccuauaagaaaguacagcaaaaaggggaaaggacccgaaaucaagucccugaaauacuaugacaacaaguuggguaaucauauugauaucaccccagugaacucacagaaccagguugugcuccaaagccugaagcccuggaggacagacgucuacuuuaauccucagacuucuaaauaugagcuaaugggccugaaguacuccgaucuccgauucgaaaaagggaguggaagcuauggcauuucuccagagaaguacaacaaagugaaggcaaaggaggguguagacgaagauuccgaguuuaaauucacccuguauaagaaugaccuuaucuugauaaaagauacagaaacuggggagcagcagcuguuucgguacggcucacgcaacgacaccaguaagcacuacguggaguuaaaaccguaugaaaaggcuaaguucgagggaaaucaacagcucaugaaccugcuuggcacgguugccaaagggggacagugucugaagggcaucaauaaacccaaccuaagcauuuacaaggucaaaacagacgugcucgguaauaaguauuuuaucaaaaaggaaggggaucagccucaacugaacuucaagaaaaagauuuga

SEQ ID NO: 2801 - RNA, 3378 nt, Artificial Sequence
  Cas9 variant
augaccagcaagcaggagaaccugggcgcccucacauucgggcuugacaucggaauugcuuccguggguugggcaguccugggcgaaaauagaauaaucgauuuggggguuaggugcuuugacaaagccgagacugcgaaggaaggagagucuuuaaaccuggcucggcgcauggcccgacuacuccguagaaggcugcggcgcagagcauggaggcuuacgaaacuggcccgguugcucaagcgcgaaggccugauugcugaugcaaaucuguucaaaaacaagaucgagaagaauacccccgugccuaaaucaaguuggcagcuccgaguagacgccuuagauagaaagcugaacgcugaggaaugggccagggugauuuaccaccuuuguaaacaucgggguuuucacuggaucagccgugcggaggaaaaggcagccgaguccgacucuaaaggggagucgggaaaggucaagcagggcuuggcuggcacuaaaaagcugaugcaggagaaaaauuaucgcacagccgcagaaauggugcuagcugaguucccagaagcccagagaaacaagcaaggggauuacucaaaagcgcucagcaggauacugcuuggagacgaacugaagaccuuguuugagcaucagcggaaacucgauaguccguucgccacagagaagcuggaagcagcuaucuuagguaauggcgaccgaaaguccgggcuguuuugggcccagaaccccgcucucgccggaucugaucuucugaaaauguugggcuauugcaccuucgagaagacugaauaccgcgcaccuaaagccagcuuuacagcugagagacacguuuggcuaaccaggcugaauaaccuccggauuguggucgacgguacgacucgcccacugaaugaagcggagagaaggaucgcacuucugaugcccuaucagcaagccggggauuucaccuacaagcaguugcguacagcucucacuaaagccggauuucugccugaguccuuccgguauaccggcuuaucauacgcaaguggccagaaggccggggaaaagacaaaagacccagagagcgcugcccuggugaaguuucccgcauggcaggaacuacgaaaaacccucgagaagaaagaacuggcgucugaguggcaaaagauuuccacggacgcucuugauggaaagccucaguugcuggaccagaucgccuggguacucucaguuuacaaagaugacgaugaggugaaggcagaacugagcaaacuuaaccugccaaaugccgagaagaugauagacgcuuugcucgauauuagauucgacaaauucaguaaccugucuuuaaaggcccuguguaagaucgucccgcuaauggaacaaggucagagguaugaugaggcaauugcuaacauccccgaguacggccaucacucccagcuccacaaagugggggccggagaacauaaguaucugccuccauuuuacaaagagcgcgacaagacuggccggaugguguucaaugaugacauggacauccccagaaacccugucguucuuagggcguugaaucaggcccgcaaagugguaaacgcucugauuaagaaauaugauagcccacacgaagugcauauagagauggcacgagaccucucgcggccccuggaugaacguagagaggucgagaaguuacaaaaggaauuuagggacaauaacgagaaagguaaggcccaguucgcucaggauuuuaauaucgugggggccguuaaaggcaaggaguucgaaaaauaccagcuguaucgcgaacaacagggaaagugcgcauacucuauugagccgauggacauccaccggcuuuuugagcagggcuacguggaaauagaucacgcguugccuuauuccagaucauucgacgauaguaagaacaauaggguccucgugcuggccaaagagaaccgagacaaggggaaucgcacacccuuugaauaccuaggagguaaagauaacagcgagccauggcggcaguucguagcuuuuguugaaggcaauaaggccuauagacuggcaaaaaggucccgucuccugcgcaaggacuucggggauaaggaggcuaaagaguuucgggaaagaaaccuuaaugacaccagguacauuuguaaguucuucaaaaacuauguggagcaauacuugcagcugcaugaagacucugaggccaagcgaugcgucguguuaagcggacagaugacuucauuucuccgggcacgcuggggccuggucaaagugagaggugauagugacaggcaccaugcccuugaugcugcgguuguggccgcauguucccacgggaugguaaagcggcugagcgacuauucucgaagaaaggaguuggaacagguccgcgagggcuucguggauguugacacaggagaaaucgugaacccugcuauguuucaacagguccaggagcauuuccccaauccauggccccacuuuagggaugaagugaaacuccgucugucaauggacgauccugcccuacugcggagugagauggagaaguucggcaccuacacgccagaagcccuccaagcucugcacccgcuuuuuguaagcagagcaccccagaggcgcaacuccggggccgcgcauaaagacaccaucuacgcucagccuaagcgauugguggcccagggagguguuacacaaaaagucgcacugacuucuuuaacccucaaggaucuggacaaacuuauugauccacacagaaaugacaagcuguauacagccauccgggcuaggcuagagcagcauggcgggaagggagacaaagcauuccccucgagcaacccucuccgcaagccagauuccgaaggcaaucccacugguccgauugugcguggggugaccauggucauagacaaacugucaggcaucccuauuagaggaggcaucgccaagaacgauaguaugguucggguggacguguuuacaaaagcgaauaaguuccacuugguaccagucuacgugcaccauaccguugcuaaggcccugcccaacagggcaguggucgccuuuaaagaugaggacgaauggacuuuaaucgaugacucuuucgauuuuugcuucagccuccacccuaaugaccuggugcagguucagcaaaaggggaaagcuggaaugauuggcuauuacuccucaugucaucgcgguacggggaacauaaaucuuugggcccacgaucgaaaccugcaagugggaaaggacggcaugaucgaggguauuggcguaaaaacagcauugagccucgagaaguucaaugucgacgugcuggggaacagauaucccgcuccaccugaaaagcggagggaucuagccuga

SEQ ID NO: 2802 - RNA, 3378 nt, Artificial Sequence
  Cas9 variant
augaccgacagaaucagccugggccucgauauugggguggccuccgucggauucucuguucuugacauagauaaggguaaagugaucgagcugggcgcuagguuguuuaacgcaacaguagccgcggggaaucaggaccggcgcgauaugcgaggaucacguagauuacugaacaggaauaagcaacggcgcaaagacgugaguaagcuauuccaggaauacggccuccuggauaacuuugacagagauaauuuccacacugcuuuuaacaauaacuggaaucccuaugagcuuagggucaaaggucugacgaagcaguugaacaaggaagaacucgccgacagccuguaccagauuaucaaacggcgcgggauuuccuaugcacugaaggaugccgacgcuaaugaagauggaaccgacuacucuucgucacucaaaaucaacagccaagaguuaauagagaagacuccugcacagauccagcugcagcgacuuaaugacuauggcaaagugagaggcaagguuauugugggggaugacaucgaugaccaaaaggucuugcugaacguguucccaacaaaugccuacgaaaaagaggcuaggcagauuaucgccacccagcagcaauuuuauccggaaauacuaacaggagaguucguaaaggaguacugccagauucucacccggaaacgugauuacuuuguuggucccggcaacgaaaagagucgcacugacuaugggaucuacaaaacagauggaagaacccuggacaaccuuuucgaggaacugauuggccaugauaagaucuauccugacgaguugagggcguccgcagccucuuacacggcucagcucuuuaaugugcugaacgauuuaaauaaccugcggauccucagcuaugaagacgguaaacuuacucaaauugacaaggagaagauaaucgccgagauuaaaaauaacaccacagucgugaauaugcugaacgugaucaagaaagucacugggugucagaaggaugacauaaaaggauuccgauugaaugaaaaggauaagccagagauuuccucaaugcccaucuaccgcaaagcacacaaggacuuucuaaaaguuggcaucgauauuaccgacuggccuaucgauuucauugacagacugaguuucauacucacacugaacaccgaaaauggcgagaucaggaagcagauuaacaaacggcuugugccagauuuugacuuccugaaugaugacuugguacagcucaucaucgauaacaaggacagcuuugacauuaagacgaauaacaaauggcaucgcuucucucugaagacuaugaacaaauuaauacccacaaugaucgaaagaccuguggagcaaaugacccugcuaacugagauggggcucauuaagaaagauacaaagagguuugaaggaaauaaguaucugccauacaaagagaucgcuaacgacauuuucaauccggucgccuccaagucagugcgugaagcgcuuaaaaucguuaacgccguguugaagaaauacggucacauagaguauaucgucauugaaaugccccgggauaagaaucuggacgaggagcgaaaacagaucgcagauuuucagaagaagaacaaaaagauuaaagacgcugccuucaaugcuuuugugaaggccguaggcagcaaaaagaacguuaagaucgcacucaguaaaaauagaaagcugcagauggggauaaggcuuuggcaucaacagcagggaauugauccuuacaacggcgaagagaucaaugccaacgaccugauuucuaauccagauaaauucgaaaucgaccacauaaucccccaguccauuagcuuugaugacgguaucaacaauaagaccuugugcuucgcuucgaugaaccaagugaaagggcagaagacgccuuaugaguuucucaacgagggccacggacagggcuacgcgaaguucaaagcaauugucucuaagaauaaaaacuucuccaaggccaaacgcgauaauuaucuguuugaagagaacgugucaaauaucgaaacccggaagagauucuuaaguaggaaccuggucgacacacgcuacagcucccgagugguucuaaauucucuccaggaguuuuuccaugaaaagagcgacgauacuaaagugaccguaauacgggggaaguuuacaucaaacaugcguaaacacuggcauauugacaagacuagagauaccuuccaccaccaugcuaucgacgccaguaucauugcagccacaccauuucugaggauguggaaaaagggauccaccaucuuccccacuaaaauuaaugagacgagcauagauaucgagacaggugaaauucuugacgauaagaacuuugacaaggucauguaugaggaaccguacucuggcuucaucucagagauuaugaaugcugaugaccgcaucaaauuuagucaccaaguggauaagaaaaugaaccggaagguuagcgacgccaccauauacuccacuagaaucgggaaauugucuaaggacaagaaagaugcagaauauguggucgcgaaggugaaagacauuuacucgguagauggauaugagaauuucaagaaaguguacaagaaggacaaaaccaaguuucugcucuauaaauacgauccuaggacauucagcgagcuggaaaagaucguuauugacuaucccgauaaaaucgagaagguccagaccaacggcaagauaaaagcuguggacauuuccccauucgaauuauaccgacgcgauaaugguauggugcggaaguacaguaaaaagacugggccugccaucaaacagcugaaguaucuugacaagaaauugggcucacauaucgauauuacacccaagaacgcaaacaauaaacacgucguucuccaaucucugaagccauggagaacggacguguaccuaaaccaugagaccggagaauaugagauaaugggcaucaaauacagcgaucugaaguuuaauaaaaacgagggguauggaauuaagaaggacaaauaccucaagaucaaaaauauugaagguguguccgagaacucagaguucauguuuagccuguauaggaaggaccguaucaaaguacaggauauggagacuaaugagucugucgaacuuuuguucuggucccgcaacuuuaguaauaagaaguacgccgagcugaaacccauaagccagaucgacaacgauaagguguuaccuauuuacggccgggggagacucaucaaaaggcugauuccaaagaauuguaaaaucuggaagguuaacacaucuauacuuggagacaccuauuaccuggaaaaggaguccaauuauccgcagaaaauuuuggauuga

SEQ ID NO: 2803 - RNA, 3381 nt, Artificial Sequence
  Cas9 variant
augaacggccuggugcucgggcuugacaucggaauugccagcgucgguguuggcauacugaauaaggagaccggggaaaucauucacgcuaacuccagaaucuuccccgcagccacagcggauucuaauguggagaggcggggauuucgccagggccgacguuuggguagaaggaaaaagcaucggucagcucgcuuaaacaaucuguucgaagaguuuggguucauuacugacuuuagugccaucccucuaaaccucaauccauacgcacugagaguaaaaggacuuagcgaagagcugacgaacgaggaauuguucauagcccucaagaauaucauuaaaaggcggggcaucuccuaucuggaugacgcuucugaggauggcgaaaccgcaucgaacgaguacgggaaggccguggaggaaaaucgcaagcugcucgcugacaaaacaccgggacaaauucaguuagagcgauuugaaaaguauggucaggucagaggcgauuucacugugguugagaacggggaaaaucacaggcugaucaacguguuuucaaccagcgccuacaaaaaggaggcggagcggauacuucgucgccagcaagaauucaaugucagaauuagugacgaguuuaucgaagcauauuugacaauucugaccggaaaaaggaaguacuaucauggccccgguaacgagaagucccggacugauuacgggcgauuccgcacagacggaaccacgcuagauaacaucuuuggcauccucauuggcaaaugcacuuucuacccugacgaauauagagccgcuaaggccucuuacaccgcacaggaguucaaucugcuuaacgaucugaauaacuugacagugccaacugagaccaaaaagcucagccccgaacagaaaaggcagauaguagaguaugcucggacagccaagacccuggggacgccuacuuuacugaaauacaucgcgaagcucguugacggauccauugacgauaucaaggguuaucgcauagacaaaucagauaagccagaaaugaugcacacauuugacgccuacagaaaaaugaggacccuugaucuggugaauauugacgcauugagucgugagacucuagaugaccuggcucauauccucacacugaacaccgaaagcgagggcauccuugaggcccugaauucuaagaugcccuccacguucaccaaagaacaaauugaugaguugauccaguuucggaagaagaacucagcugucuucgggaaaggauggcacaauuuuagccucaagcugaugaacgaauuaauuagugagcuguaugagacaucugaagagcagaugacuauacuaacccgacucggcaaacagagauccagggaaaucagcaagcgcacaaaauacauugacgagaaggaacugacugaggagaucuacaauccugugguggccaagucgguccggcaagcaaucaaaauuauaaacgaagccaccaagagauaugguaucuucgauaauauuguuaucgagauggcuagggaaaacaaugaggaagacgcgaaaaaggacuacauuaaacgccagaaggcaaaccaggaugagaagaacgccucuauggagaaagcugccuuucaauauaaugggaagaaagaacuuccagacuccaucuuccacggccauaaggaguuggcaacaaaaauacgacuguggcaccagcagggagaacggugucucuacaccggcaagaacaucucaauucgugaucugauccauaauccgcaccaguaugagauugaccacauccuuccccugaguuugagcuuugaugacgggcucgccaacaaagugcugguauuagcuacugccaaucaagaaaagggacagagaacgccuuuccaggcaauagauuccauggacgaugcguggucuuacagggaguuuaagcaguaugugcgcaacagcaaaucacugaguaauaagaaaaaggacuaccuacucacagaggaagauauuuccaaaaucgaggucaagcaaaaguucauugaacggaaccugguggacaccagauacagcucuaggguugugcuuaauacuuugcaggaguuuuauaaaaccaacgauuucgacacaaagaucucagucgugcgaggucaguucaccagucagcugcgccggaaauggaagauagagaaaagcagagacacuuaccaucaccaugcuguagaugcccucaucauugcagccuccucucaacugagguuauggaagaagcagaauaacccacugaucucguauaaagaaggccaguuuguugaccccgagacaggggaaauucuuagcuugacggaugacgaguacaaggaacucguguuccguccuccauaugauuacuuugucgacacccugaaauccaagucauucgaggauaguauccuauuuucuuaucagguggacagcaaauacaaucgcaagauauccgaugcuacuauuuacggaacacggaaggcccaacugggcaaagacaagcaggaggaaaccuauguccucgguaaaaucaaggauaucuacucacagaaaggguaugaggacuucauuaagagauacaacaaagaugaaacacaauuucugaucuaucacaaggacccccagacuuucgagaaggugauugaagagauacuuaaaaccuacccggacaaggaguugaaugaaaaaggcaaggagaucccuugcaaccccuuugaaaaauauaggcaggagaacggaccaauucgaaaguacagcaagaaaggcaaggggccugaaaucaaaauucugaaguacuaugauaauaaauuaggaaaccauaucgacauaacgcccguuaauucucagaaccaagugguacuccagucccugaagccauggcggaccgaugucuacuucaauccccgcacaaguaaguaugagcuuaugggucugaaauacagcgacuugagauuugagaagggcucuggguccuauggaaucucaccugaaaaauacaacaaggugaaagcaaaggagggcguuaaugaagauagugaguucaaguuuacucucuauaaaaacgaccugauucuaaucaaggauaccgagacaggugaacagcagcuguucagguacgggagccggaaugacacuucgaaacacuacguggagcucaagccauaugaaaaagcuaaguucgagggcaaccaacagcugaugaaucuuuugggaaccgucgccaagggcgggcagugucugaaaggaauuaacaagccgaauuuauccaucuacaaagugaagacggauguacucggcaacaaauauuuuauaaagaaagaaggugaccagccccaacugaauuucaagaagaaauuuuga

SEQ ID NO: 2804 - RNA, 3381 nt, Artificial Sequence
  Cas9 variant
auggccagcaagcacgagaaccugggcgcucucaccuucgggcuugacaucggaauugcauccguggguugggccguccugggcgaaaauagaauaaucgauuuggggguuaggugcuuugacaaagcggagacagcuaaggaaggagagucuuuaaaccuggcccggcgcacugcacgacuacuccguagaaggcugcggcgcagagccuggaggcuuacgaaacuggcucgguugcucaagcgcgaaggccugauugcagauaccaauguguuccagaaacccuuuaaccugaaggacgccaaugagaagggucucucauucuggcaguuacgaguagaugcucuggacagaaaacuuagugccgaggaaugggcgagggugaucuaccauuuguguaagcaccggggguuucauuggauuagccgugcagaggaaaaagccgcugagggagauuccaagucugagggcggcaaagucaagcaggggcuggccggaacaaagaaacuaaugcaggaaaagaacuaucgcacugcagcugagauggugcucaccgaguucccugaagcccagagaaauaaacaaggugacuacucgaaggcgcugucaaggauccuucugggcgaugaaaugacacaguuguuuaaacaccagcgggagcucgggaacccacaugccaccgagaagcuggaagcagcuauauuaggaaauggcgaccacaaaagcggucuguucugggcccagaacccggcucucgccgggaaugaucuucugaagauguugggacacugcacuuuugagaaggcagaauaucgaguucccaaagccaguuucacagcugagcgccauguguggcuaaccagacugaacaaucucaggaucgucguggacggcacgacucggccucugaacgaagcggagcgccaccuugcacuguugaugccauaccaacaggccggcgaucucaccuauaagcagcugagaacagcuuuaacuaaagccggguaccugcccgaguccuuuagguauaccggacuagcauacgccucuggucagaaggcugacgaaaaagccaaggacccugagagcgcaccacucguaaagcugcccgcguggcaugaacuucguaaaacauuggagaagaaagaacuggcuuccgaguggcaaaagauuucaagugaugcccucgacggcaaaccucagcugcuugaucagaucgcauggguucugagcguguacaaggacgauaccgaggucgaagccgaguuguguaagcucaaucugccaaacgcugagaaaaugauugacgccuuacuggauauccgguucgacaaguuuucuaaccuaucccucaaagcacugcgacaaauagugccgcuuauggaacaggggcagagauaugaugaggcuguggccaauauucccgaauacggacaccacucacaguugcaugaggucggcgcgggugaacacaaguaucugccuccauucuacaaagagagggacaagacggggcgcaugguuuucaacgaugacauggacaucccccggaauccugugguacucagagcccugaaccaagcuaggaagguggucaaugcauuaauuaaagaauauggcagcccacaugaggugcacaucgagauggcccgcgaucugagucgaccccuugacgaacggcgugauguugagaaguugcagaaagaauuuagagacaggaacgagaaggauaaagcucucuucgcccaggacuuuaauaucgugggagcagucaagggcaaagaguucgaaaaguaccagcuguaucgcgagcaacaggggaagugcgcguacucuauugaaccgauggauauacaucggcuauuugagcagggauacguggaaaucgaccacgcccugccuuauuccaggagcuucgaugacucgaaaaacaauagaguacucguucuggcuaaggagaaccgagauaaagguaaucgcacucccuuugaauaccuuggcgggaaggacaacucugagcgguggagacaguucguggccuuugucgagggaaauaaauccuauagguuggcaaagcguucacgccuguuacggaaggauuucggcaaagacgaagcuaaggguuuuagagagaggaaccucaaugacacacgauacauuugucgguucuuuaaaaacuauguggaacaauaccugcagcuucacgaggauagugacgccaagcgcugcgucgugcugagcgggcagaugaccuccuucuugagagcaagguggggccucguuaaagugcggggagauucugaccgacaucacgcccuggauggcgcuaucguagcggccuguagccauucaauggucaagagacuaagugacuauucccgcaggaaggagcuggaacaggugcgugcaggguucguugauguggacacuggagagauagucaacccagcuauguuucaacaggugcaggaacacuucccuaaucccuggccacacuuucgggaugagguaaaacucagacugaacguggacgaucccgcccuuuugcauagcgaaaugaauagguucgguacauacucuccugaggcccugaaggcuuuacgcccacucuuuauuucacgagcaccgcaaagacggaacaguggcgccgcgcacaaagacaccaucuacgcucagcccgagaggcugguugcccaagggggagucacgcagaaggugccucuuaccagccugacacuaaaagaucucgacaagcugaucgacccacaucgcaaugaaaaguuguauuccgcaauucguaucagacuggagcagcacggcgguaaaggggauaaggccuuccccgcuucuaacccuuuacggaaaccagacucggaaggcaaucccacuggaccgauugugaggggcgucaccaugguuauagauaagcucagcgggaucccuauucgcggaggcaucgccaaaaacgacuccauggugcgaguggauguauuuacaaaggcagguaaauuccaucuggucccaguguacguucaccacgcgguggcuaagguccuucccaauagagccgugguugcauauaaggacgagacugaauggacccugaucgaugacggguuugauuucugcuuuucaauguacccuaacgacuugcuccggauuaaacugaggaaugccagucaucuaggauauuacgcuucuuguaaccgcagcacaggcgccauaaaucuguggucccacgauagaaaccaacagguggguaaggacggcaugaucgagucaauugggguaaaaaccgcacuuaaugucgagaagcucaacaucgacgugcugggaaacagguaucccgcuccaccugaaaaacggcgugauuuggccuga

SEQ ID NO: 2805 - RNA, 3384 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauguagagaggcggauuaaccgccaaggacgacguuugacaagaaggaagaaacaucggcgcgugagauuaaaucaccuguuugaagagucaggccuaaucacugacuucacgaacgucaguauaaaucucaacccuuaccagcugagggugaagggucuuaccgaugaacugagcaaugaggaguuguuuaucgcccucaaaaacaugguuaagcaucgggggauuuccuaucuggacgaugcgucugacgauggaaauucgucagugggcgacuacgcucagaucgucaaggaaaacagcaaacagcuggagacaaagacuccaggccaaauucagcucgaacgcuaucagaaauacgggcaguuacgaggagauuucaccguggaggaggacgguaagaaacacagacugaucaauguauuuccgacaagugccuauagggcagaagcccuucggauauugcaaacccagcaggaguucaacccccagauuacugaugaauuuaucaauuccuaccugcaaauucuaacaggcaagcguaaguauuaccaugggccuggaaacgagaaaucucgcaccgacuacggcagauauacgacuaagaaagauagcgaagacgaguacaucacccucgacaacaucuucgguauucugauagggaagugcacauuuuauccagaggaauacagggcugcaaaagccuccuauacugcucaggaguucaaucuucugaacgauuugaauaaccucaccguucccacagaaaccaagaaacugucagaggaacagaagaaucaaaucauuacgaacgugaagaaugagaaagccaugggaccugcgaaguuauuuaaauacaucgcaaagcugcucaguugugacgucgccgauauaaaaggcuaucggauugacaagagcgauaaggcugagauccacacuuucgaagccuaccgaaaaaugaagacacuugcaaccaucgacauugagcagauggaacgcgagaaccuggauaaauuggcuuacgugcuaacucugaauacagaaaaggagggcauccaggaggcccucgaacacgaguuugcggacgggaccuucucucaggaacaaauugaugagcuggugcaguucagaaaagccaacuccucaauauuuggaaaggguuggcauagcuucagugucaagcugaugauggagcuuaucccagaauuguaugcaacgucugaggaacagaugaccauucucacaaggcugggcaaacagaagacuaccuccagcucgaauaaaacaaaguacaucgacgagaaacaauuaacugaagagaucuauaaccccguugcugccaagucugugcggcaggcuauuaagauaguaaaugccgcaaucaaagaguacggggauuuugacaacauugugaucgaaauggcccgcgagaccaaugaagacgaugagaagaaagcuauucagaagauccagaaagcgaacaaggacgaaaaagaugcagccaugcugaaggcugccaaccaauauaauggaaaggcagagcuaccucacuccgucuuccauggccacaaacagcucgccacaaagauaagacuguggcaccagcagggugagaggugccuuuacaccgggaaaacuaucucaauucaugacuugaucaacaauaguaaccaauuugaaauugaucacauccugccacucagcauaacguucgacgauucccuggcuaauaaggugcuuguuuaugccacagcaaaccaggagaaaggccagcguaccccguaccaagcgcuggacucuauggaugacgcuuggagcuuucgggaauugaaggccuucgugcgagauucaaaggcacucaguaauaaaaagaaagaguaccuguuaacugaagaggacauuuccaaguuugaugucagaaagaaguucaucgagaggaaccugguggacacccgcuaugccagccggguaguucuaaaugcucuccaggaacauuuuagagugcacaagacagacaccaaagucucuguggucaggggacaguucacuucacagcugcgccgacauuggggcauugagaagacacgggauacguaccaccaccaugccguggacgcacuuaucauagcugccaguagccaauugaaccuguggaaaaagcagaaaaauacccucguuuccuauucugaagaucagcuguuagacaucgagacuggggagcugauuucggaugacgaauacaaggagagcguguuuaaggcgcccuaucagcacuucguagauacacuuaaauccaaggaguucgaagacucaaucuuguuuaguuaccaagucgauucuaaauucaaccguaagauuagcgacgccaccaucuaugcuacaagacaggcaaaagugggaaaggauaaaaaggacgaaacuuacguucucgguaagauaaaagauauuuacucccagaccggcuaugacgccuuuaucaagaucuacaaaaaggacaaaucaaaguuccugauguauaggcaugauccucagacguuugagaaggugauugagccaauccuagaaaauuaccccaacaaagagcugaaugaaaaggggaaagaggucccuuguaacccauuccucaaguauaaagaagaccacggauacauucgcaaguauagcaagaaaggcaacggucccgagauaaagucucugaaauacuacgauuccaaguuggggaaucacaucgacauuaccccgaaaaacaguaauaacaaggugguacuucaaagcgugucuccuuggcgggcugauguuuauuuuaauaagacaacuggcaaauacgagauccugggauuaaaguaugccgaccucaaauucgaaaagggcaccgggacauacaaaauuuccgaggaaaaguauaacgauaucaagauaaaagagggagucgacucagauagugaauuuaaguucacucuguacaaaaaugaccuucuguugaucaaggauaccgagacgaaagagcagcagcucuuuagauuccugagcaggacaaugcccaacgugaagcauuauguggaacuaaaaccauacgacaagcaaaaguuugacgauaaugaggaacugauuaaaauccucgguauugucgcaaagggcgggcagugcaaaaagggaguuucgaaaccuaacaucuccauauacaagauucgaaccgacgugcugggcaaucagcacaucaucaagaacgagggugauaaacccaaacuugacuucuga

SEQ ID NO: 2806 - RNA, 3384 nt, Artificial Sequence
  Cas9 variant
augaacggccuggugcucgggcuugacaucggaauugccagcgucgguguuggcauacuggagaaggauuccgggaaaaucauucacgcuaauucuagaaucuuccccgcagccaccgcggacaacaauguggaaaggcggacaucacgccaggcucgacguuugaacagaaggaagaaacaucggaguguacgcuuacacgaucuguuugaggaauacggacuacucacugacuucagcaagguguccauuaaucugaacccuuaucaaaucagaguccagggccuugauaaaaggcugacgaaugaggaauuguuuauagcccucaagaacaucgugaagcggcgcgguauuucuuaccuggacgaugcaucggaggacgggggagccguuucaagcgauuauggcaaagcuguggaggaaaaucgaaagcugcucgcacagcagaccccaggccaaauccaguuagacagauucgagaaauacgggcaggucaggggagauuuuacagugguagaaaacggugagaagcggcgucugauuaauguuuucaguacuuccgccuaucgcaaagaggcugaaagaauccuuaggaagcagcaagaguuuaacaauaagauaaccgaaggcuucauugaggacuacuugacaauccugaccgggaaacggaaguauuaccauggaccgggcaacgaaaaaucucgaacugauuacggucgcuauacaaccaagaaagacagccagggggaguacauuacgcuagacaauaucuuuggaauccucauuggcaagugcacuuucuaucccgaugaguacagagccuccaaagcgucauauaccgcacaggaauuuaaccugcuuaacgaccugaauaacuugacagugccuacugagaccaagaagcucagugucgaacagaaaaagacaauaguggaguacgccaaaaccgcuaagacgcugggcgccagcacuuuacugaaauauaucgcaaagcucauuggggugucugucgaucaaauccacggauacaggauagacccaaaugaaaagcccgagaugcauacauucgagguuuaccggaaaaugcagucccuugaaaccauucgcguggaggaacugccuagaaagguaaucgaugaguuggcucacauccuaacucugaacacagaaagggaggguauugaggaagccaucaaugcgaaacucaaggacauauuuucacaggaucaagugcuggagcuuguccaguuccguaaaaacaauagcagucuguucucuaagggcuggcacaacuuuuccuugaagcucaugauggaacugauuccagaguuauaugagaccagcgaagaacagaugacgauccugacccggcuagggaaacagaagucgaaagaaacaucuaagcgaacuaaauacauugacgagaaggaacucaccgaggagaucuauaaucccgugguugccaaguccgugagacaagcaaucaaaauuauaaacgaagcuacaaagagguacggaaucuucgauaauauugucaucgagauggcccgcgaaaacaaugaggaagacgcuaaaaaggaguauauuaaacggcagaaggccaaccuggaugagaaaaaugcagccauggaaaaggcugcguuucaguacaacggcaagaaagagcuuccugacaacguguuccauggucacaaggaauuggcaacuaaaaucagacuguggcaucagcaaggggagaagugucucuauaccggcaaaaauauaccaaucucagaccugauucagaacagguacaaguacgaaaucgaucacauucuuccgcugaguuugagcuuugacgauucccucucuaauaagguacugguuuuagccacagcuaaccaggagaaaggacagcgcacccccuuccaagcccuggacagcauggauuaugcauggucauaccgagaguuuaagaguuaugugaaagacuccaagcuacucagcaauaaaaagaaggauuaccugcuuacugaagaggacaucucuaaaauagaagucaagcagaaauucauugagcggaacuugguggauacgcguuauucaaguagagucgugcugaaugcccuccaggacuuuuacaaggagcaccaguucgauacaaccaucagcguugugaggggccaauuuacuucccagcugcgccggaaaugggggauugaaaagucuagagagaccuaucaucaccaugcuguagacgccuuaaucauagcagcgucgagccagcugaggcuuuggaagaaacacaacaauccuuugaucuccuacaaggaggagcaauucgucgauucagaaacaggagagauuaucaguaugucugacgacgaguacaaagaacucguguuuaaggcuccauaugaucauuucguugacacccugaaaagcaagaaauucgaggauuccauucuauuuucauaccagguggacagcaaguauaaccgaaagaucucugaugccacuauauacgcaacacgcaaagccaagcuggacaaagauaaguccgaagagacguauguccucgguaaaauuaaggacaucuacagucaggcuggcuaugauaccuucaucaagauuuacaauaaagacaagagccgguuucugauguaccacaaagauccccagacuuucgaaaaggugaucgaggagauucuuagaacauauccuucuaaagaauugaacgagaagaauaaggaaguaccaugcaaccccuuugagaaauacaggcaagaaaaugggccgauacguaaguauucccgcaaaggaaacggcccugagaucaagucacugaaauacuaugacaacaaguuagguaaucacauugauaucacccccaacgagaguaugaaucaggugguucuccagagccugaagccauggcggacagacgucuucuuuaaccaucagacugaaaaauacgagcuuauggggcugaaguauucggacuugaauuucgaaaaaggcuccggaaaguacucuauuagccucgagaaauacaacucaaucaagaugaaugagggcgugagugaagaguccgaauuuaaguucacccuguauaaaaacgaucuaauacugaucaaggacgcccucacgaaagaggcacaaauuuuuagauacgggucuaggaaugauaccagcaagcacuauguggaacugaaaccuuacgacauguccaaguucgagggagaugagcgacuuaucaaagucuuggguacaguugcuaagggcgggcgguguauuaagggacugaacaaaaaggacaucucaauauuuaaagugaagacugauguguuaggcaauaaacauuucauuaagaaggaaggugaggaacccaaacucaaguucuga

SEQ ID NO: 2807 - RNA, 3387 nt, Artificial Sequence
  Cas9 variant
augaccaagcugggcaaacccuacgggaucggaguggacauugguagcaacuccauaggcuucgccgcugucgaugaaaauucucaccucaucagacuuaaggggaaaacaguuauuggagcaaggcuguuugaagagggcaaggccgcggcuaaacggcgcgccggucgaacuacgcguagaagguugucacggaaccgcuggagauuaaguuuccugagggacuuuuucgaaagccauaucaccccuacagauccaaacuuuuucaugcggcagaaguauuccgagauuucuccgaaggacaaagcacgcuacaaguaugaaaaacgacuauuuaaugauagaacugacgccgaguucuaccaacaguauucgaccauguaccaccucaggaaucggcugaugacagaucccucacgugcugacgugcgcgagaucuauuuugcaauacaucacauccuuaagagcagagggcauuuccugaccccuggagaugccaaagacuuuaacacuaaugauguagcuuuggacgaaauuuucccagcccuccaggaugcguacgcacagguguaccccgaccugggcaucacauuugacgaggauaaggccaacgaguucaagaccauucugcucaaugagaucgcuacgaguauagacacucaaagggccuuagucaaacugcuuuuggcagaggaagaugacaaggauauucugaaacagcagaaacaggugcuaaccgaguucgcuaaagccguugugggccucaagacaaaacugaaccuugcgcuggggacugaagucgacuccucugaggccaccgcauggaauuuuagcuugggacaacucgaugacaagugggcugguaucgaauccgccaugacagaugagggcaccgagauucuggaccagauccgggauuuauaucgagcucgccugcucaacgggaucgugccuacgggaaagacucuuucacaggccaaaguagacgacuacacacagcaccacgaagaucugcaauuguucaaggcauaucuaaaacagcuggaggacgauggcaccgccaaggcuauuagacagcucuacgacagguauauagauggugacgaugcggcaccauuucugcgggaaaauuucguuaaagcccuuacuaaggacgugacagcucaucccaacaccaagaguccugagcuguuggaacgccucgcccaaccagauuuuaugcugaaacagagaaauaaggcaaacggggccaucccgguccagaugcagcaaagggaguuagaccagauuaucaaaaaccaggcuguguacuaugauuggcuggccgcacccaauccuguggagaagcaccguaaaagcaugccauaccagcuagacgaacuccugaacuuccggauacccuacuaugucggaccucuuguuacggcgaaggagcaaaaggcugcccagggcggcguguuugcauggaugguacgaaaagauccagaagggaauauuacccccuacaacuucgacgagaagguggacagagaagccucugcuaauacauuuauccagaggaugaaaacuaccgauacauauuugaucggagaggacguccugccgaagcagucccuccuguaccaacgcuaugaggugcuuaacgaacugaauaacguucgggugaauaacgagaaauugucaauugaacagaagcagcaggucaucagagagcuuuucgagaggcauaauagcgugacuauuaagcaauuugccgaaaaccugcgcgcacacggugauuacgcucacauaccugagauccgaggcuuagccgacgaaaaacgguuccugaguucucuauccaccuaucgucagcucaagagccugcuucccgaggcgauugaugacccagccaaacaggcugauaucgaaaauaucauugcauggucgacaguauuugaggacgccgcuauauucaagaccaaauugaaggagaucucuuggcugggguccgaagccauuacuaaacucucaaacaucagauacaggggauggggccaauucagucgcaaguuucugaaugguuuaacgcuggggaacggccauacaauuauccaggagcuuuugcucagcaccaacaaucugaugcagauacuaacugaugaaacccugcagaagaaaaugacagagcucaacgcagacaagcugaaaaccgcgaauaucaacgaugccauugacaaugcuuacacuuccccuucuaacaagaaagcccuucggcaaguuuugagaguggucgaugacaucaagagggcagcugacggacaggaucccagcuggcuguauguggaaacagccgacggcgggggaacgccagguaagcgaacccgcgcacggcagcaccaguuacaagagauuuacgccaaugcugcgcaugagcucaucgauacugccgucagaggcgaacuggaggacaaaauaucagauaaggcagacuucaacgauaggcuugugcuguauuuuaugcaagggggacgugacauuuacacaggcgcucccuugaauaucgaucagcucaguuccuaugacauugaucacauccugccucagagccuaauaaaagacaacucucuggacaaucgcguucucgugcaugccaucauuaaccgggaaaagaaugccaccuucgcuucaacaaucuacgcacagaaaaugaacgccacuuggagacaguggcacgaggcgggucugauuagugggaggaagcuccgaaauuugcagaugcggccagaucaaaucgacaaguaugcuagcggcuuuguagcccgccagcuggucgaaaccagacagauaauuaaauuaacggagcagaucguggcagcccaauacccggauaccaagaucauugcuguuaaagcaggacucucccaccagcugagggaggaacuugaguuccccaagaaccgggacgugaaccauuaccaccaugccuuugaugcguuccuggcugcccgaaucggcacauaucuacucaaaagauuuccuaaucugcaggcauucuuuacuuacgggaaguucaccaaggccgacgucaaaaaguugcgcggauuuaacuucauuagggauauaacacacgcugaagacaaaaucguggccaaggauacuggugagguagugugggacaaacagcgugauguugacgagcuggaucggauuuauaauuucaagagaauguuaaucacccacgaagucagguuugagacggcagaccucuucaaacaaacaguguacggcgcucgcgacucuaaggaagccgggggaucgaagcagcugauuccaaagaagaaagauauccagcuuauauuuaugggcgcgaucagcgagcgaaccagacccauucugccuuuguga

SEQ ID NO: 2808 - RNA, 3387 nt, Artificial Sequence
  Cas9 variant
auggacgagaagauggauuacagaaucggccuggacauugggauagccagcgugggaugggcuguccuccagaacaauuccgaugacgaacccguuaggaucguggaucuugguguacggauuuucgacaccgcagagaucccuaaaacaggcgaaucucuggccgggccacgccgagcggcucguacuacgagaaggcgguugcgcagaaggaagcaccgguuagaucgcauuaaauggcuguuugagaaccaaggacuaaucaauauagacgauuuccucaagcgauauaacauggccggccugccggacguguaccagcuuagauaugaagcacuggauaggaaauugaccgacgaggagcucgcccagguccugcugcauaucgcuaagcaccgggguuuucguucaacacgcaaggcagaaacugccgcuaaagagaauggggccgugcucaaggcgaccgaugaaaaccagaaaagaaugcaagagaagggauacaggacaguuggcgagaugauuuauuuagacgaagcauuccggaucggcugcaguuggagcgagaaaggguacauucugacuccccgaaauaaggccgaaaacuaucagcauaccaugcuucgcgcuauguugguggaggaagucaaggagaucuuuuccucucagagaaggcugggaaauaaaaaggccacagaggaacuagaggaaaaauaccucgagauaaugaccucgcagcggucauucgaccuggguccuggcaugcaaccagaugggaagcccagcccuuacgcaauggaaggauuuagugaccgcgugggcaaauguacguuccuuggugaucagggggagcugagaggagcuaagggcacuuauaccgccgaguacuuuguagcguugcagaaaauuaaccacacaaagcucguuaaucaggacggcgaaacuaggaacuucaccgaggaggaacgucgggcccugacauuacugcucuuuacccaaaaggaagugaaauaugcagcuguccgaaagaaacuugggcugccagaggauaucuuguucuacaaucuaaacuauaagaaagccgcuacgaaggaggaacagcagaaggagaaucaaaacacugaaaaagccaaguuuauuggaaugcccuacuaucaugacuacaaaaagugccuggaggagagagugaaauaccucacagaaaacgaggugagggaucuguucgacgaaaucgguaugauccuuaccuguuauaagaaugaugacucccgcacugagcggcuggcaaaguugggccucgucccuauugaaauggaggggcuguuagccuacacaccaaccaaauuccagcaccugucuaugaaggcuaugagaaacauaaucccguuucuagagaaaggaaugacguaugauaaggcgugcgaagaggcaggcuacgacuucaaagccgacagcaaggguaccaagcagaaacuccugacaggggaaaauguuaaccagacuauuaaugagaucaccaaccccgugguaaagagguccgugucacaaacagucaaagugauaaaugcuauuauccgcacuuauggcaguccucaggccaucaacauugaacuugcacgagagaugagcaagaccuuugaggaacggcguaaaaucaagggagauauggagaaaagacagaagaauaacgaagacguuaagaaacagauucaagaguugggcaagcugucuccaacagggcaggauauacucaaauacaggcuguggcaggaacagcaaggaaucuguauguauuccgguaagaccauuccccuugaggagcuguucaaaccuggcuacgacaucgaucacaucuugccauacucaauuacuuuugacgauagcuuccgcaauaaggugcucgucacgagucaggaaaaccggcagaaggggaauagaacacccuaugaguacaugggaaacgacgaacagagguggaaugaguuugagacccgagugaaaacuaccauacgcgauuauaagaaacaacagaagcugcugaaaaagcauuucucugaagaggaacgguccgaguuuaaggaaagaaacuuaacagacaccaaauacaucacuacaguaauuuauaacaugaucaggcagaaucuagagauggccccgcucaaccguccugagaagaaaaagcaaguucgcgcugugaauggcgccauuacggcauaccugcggaaaagauggggucuuccccagaagaacagggaaaccgauacucaccaugcgauggacgcugucgugaucgccugcuguacagaugggaugauacagaagaucagccgauauaccaaaguccgggagcgcugcuacucgaagggcacagaauuuguggacgcagagacuggagaaauuuuuagaccagaggacuacucuagggccgagugggaugaaaucuucggcguucacauuccuaaacccugggagaccuuucgggcugaauuggacgugcgaaugggggaugacccaaagggauuccuggauacgcacuccgacguagcccucgagcuggauuaucccgaauacaucuaugagaauuuaagaccuauauucgucucacgcaugccaaaccauaaagugaccggugcagcucacgccgacacaauuaggaguccgcgucauuuuaaggaugagggcaucguucugacuaaaaccgcgcuuacagacuugaagcucgauaaggacggggaaauugauggauacuauaauccccagagcgaccugcuacuguacgaggcccucaaaaagcaacugcuuuuguauggcaacgacgcuaaaaaggcauucgcccaggauuuucacaaaccuaaggcugacgguacugaagggccagugguccggaaggugaaaauccagaagaaacagaccaugggcguauucguggauuccggaaauggcauagccgagaacgggggaaugguuagaaucgacgucuuuagggugaauggcaaguacuacuucgugcccgucuauacggcagauguugugaaaaaggugcugccuaaccgcgcgucuacagccaauaagccauacagcgaguggcgaaccauggaagacaaagauuucuuauucucacucuauaguagagaccugguacauauuaaguccaaaaaggguauccccauuaaaaacgucgaugggagccuuggagagucuaaggaaguguacgcuuauuacaucggcgccgacauaucaggugcaaagauugagggcaaagcucacgauagucgguauacuuuuagggggaucggaguucaaaagcuggaauugaucgagaaaugucagguggacauucucggccacaucagcacagucaagaaugagaaacgcaugggguucuccuga

SEQ ID NO: 2809 - RNA, 3387 nt, Artificial Sequence
  Cas9 variant
augaacgacaagaaucagaaauacagacugggccucgaucuugggaccaacagcaucggauggugcauuuauucccuggacgugaauaacaagcccgagacauugauagauaugggugucaggaucuucucugacggccgggauccuaaaacuaaggaaccauuagccguugagcgccgaacggcucgugggcugagaaggauucuacaccggcgcaaacucagaaggcggcaaauguuucgccugcuucaggaacagggacugaugccgaaugacgcaucagaggccgcggcuuugaagagucucaaccccuacgaacugcgagugaaggcccuggauaccaaacucgagccuuaugaguuaggcagagcacuguucaaucuuagcguaaggcgggguuuuaaguccaaccguaaagaagccgugcaggagaaggaaaaagacucucaaaaugaugcuaagucgcagaacgagaagugugagcauuuggcaaaagccaucaaggacucagggugccgcacacugggagaguuccuauggaaacacaagaauacugagacccagcagacagaaaacgaugcuagaaauauuggcaugagguuugucccaggccggagcaacuacuaucccacccgacgcauguacguggaggaguucgacgccaucagaaaagcgcaagaaccuuauuacagugggguuaauugggaugcacuccaugagaagcuguuuuaccagaggccacuucgggcccaggaacgcggaaaauguagauauaugcccgacaaggagaggacuuucaaggcuaugccuugcucccagaaaauacguauccugcaagaaguguacaacauggacuauauugaugaguacgguaagacaaucccauuggaagaggcccagaccgacucucucauuagccuguuagauaaacgggagaagcuguccuuuaaagcaaugaagaaggaacucggcaucgacgagucauguacguucaaccuugaacgagggggaagagaguaucugcagggcaaugcugccgcggucaaauugaggaacaagaaacgcuuuggugaacuaugggauagucugagccucgccaagcaagacgcaauaguggagaaacugauuacugcugaugaggacgccgaaaucauuucuaugcuugcucaguacaaucugaccgaugagcagaagaagaacaucgccguaacaguuuugccguccgggacugcaaugcucugcaaagaagugaccgagaugcugguccagaagauggagcaaaauaaaauccccuuaacaguggccgugcagaugcugggauauaccuacgcugaccagucaguccgggaagaggauacgcuaccuuacuauggcgcgauucucacuggcagcacaaugggggcacacccagaagccgacgagagugaacccgagcugaaguacggaaaaauaucuaacccuaccguucauguggcucuuaaucagacuagaacaguagugaacgccuugaucaaggcauaugguaagccacaacagauugucguggagcuguccagggaccucaaagccagccgcgaagcuaaggcccgaauccagaaaaccauaacgaugaaucagaagcggaacgagcgugauaauaaaaacauuaccgacaucacaaagauccccuacccgaauagaaacgauaggcugaaauaucgccuuugggaagaacugggcucggggucuaauuccuucucacggaaguguuuguacugcggaaagccuauuaguggcagcgaaaucuuuacugagaacauugagauagaacacauccuccccuucgguagaacccuguucgacggggagacaaacaaaacuguugcacacaccgauuguaauagggacaagggcgaucgauccccauuugaagcguucggaucuagcccuaacggcuauaauuggcaugagauuugcgcucgcgccaacucacugaaaaaucccgcaaagcggacauuauuugccgaaaacgcuauggagaaauucgagaaggacaauaguuuuauccaaagacagcuaaccgauaacgccuaccucuccaggagcgcacugcguuaccuucgcuguaucugcaaggacguguggucuauuaaugggggaaugacuaaauugcugcgggauaaguggaacauagacucaauccucaaaagaaagauugaugacccagaaaucgcucacuucgagcugaaaaaugaccagauuggucaguauaagaagaacagguacgaucaucgacaccacgccuuagacgcgagugucaucgcccugauagaucgggcuauggugcaagaaaucagccagcuuaauaaaauucgcuugaagaacagaaucgaggcaccccagaugccuguacucagguccgagcugauugaaaaaguuaagcauaucacggugucuuuuaaaccagaccacggccggcaagggaagcuaucgaaggagacacugcucggaaaaauaaagaaaauugaaaaggucgauaucgacagcauucagaccgaugacaucgccuccauaaaagaugacgcuauccgaacuagauucgagaccaagcgcagggaacugggcgauauuacaaaagccaaggcagcgcuuaagaccgaguuuccgaaauuggacguguucaagacuuauuacgucucacguacacccaucgugagucugacggagaaaaauauuaacucuaucguugaugaaaagauaaaagagaaguuaaagaccuuuauuaaagaacaugccgaccucagcuucgcugagcagcugcagaaguuuuccgaaacugaguggaucgguaaaccuucagccgcagggaagccaggcaaaaaguaucggaucgagaaggugagaugcauuaacuggggacaaacacccaucaccauuacaagcucugcuguaccuagguaccuuuguccagaagacuaucuggccgcagucguguggcagauacccuccaaaaagaaagauacugagccggaauacaaggccaccuucuugcgccgagacgaguucgauguuaauaacaaaccuaagaagcucgaaaaaccacacgacgcugcgcaguacaucugcaugcuguauaaggaugacuaccuagaguuuacggagaguggcgccacccaucuguguagaauugcagggcuccccgcuagccagaauaacaaaaucgauauucggccuaucuaugccgugucugacugcaaggauuggauaaucgccacaaaugaaaacaugcuggagcccuguuggaaaccacaaaaggaagagaagaggauuuccgucaaugugcuuuucggaaaacacaaggcucgcucaguaacugugaacccuaucggucguguuuuuagaaaauga

SEQ ID NO: 2810 - RNA, 3387 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauguagagaggcggacaaaccgccaaggacgacguuugacuagaaggaagaaacaucggcgcgugagauuaaaucaccuguuugaagagucaggccuaauuacggacuucaccaaggucaguaucaaccucaauccuuaccagcugagggugaaaggucuuauagaugaacugagcaacgaggaguuguuuaucgcccucaagaauaugguuaagcaucgggggauuuccuaucuggacgaugcgucugacgauggaaacucgucagugggcgacuacgcucagaucgucaaagaaaauagcaagcagcuggagacaaaaacuccaggccaaauucagcucgaacgcuaucagaaguacgggcaguuacgaggagauuucaccguggaggaggacgguaaaaagcacagacugaucaacguauuuccgacaagugccuauagguccgaagcacuucggauauugcaaacccagaaggaguucaauccccagauuacugaugaauuuaucaaccguuaccuggagauucuaacaggcaaacgcaaguauuaccaugggccuggaaaugaaaaaucuagaaccgacuacggcagguauacgacuaagaaagauagcgagaacgaguacaucacccucgacaacaucuucgguauucugauagggaagugcacauuuuauccagaagaguaccgggccgcuaaagcauccuauacugcccaggaguucaaucuucugaacgacuugaauaaccucaccguucccacagaaaccaagaagcugucagaggaacaaaagaaucagaucauuaacuacgugaagaaugagaaagcuaugggaccugccaaguuauuuaaauauaucgcgaagcugcucaguugugaugucgcagacauaaagggcuaccgaauugauaaaagcgacaaggccgaaauccacacguucgaggcuuaccgcaaaaugaagacucuugaaacaaucgauuuugagaaaaugucuagagaccagcuggauaaguuggccuaugugcuaacccugaacacugaaagggagggcauucaagaggcacucgaccacgaguucgcugaugggaauuucucccaggaacagaucgacgaacuggugcaguuucggaaggccaacucaagcauuuucggaaaagguuggcauaauuuuagugucaaacuuaugauggagcugauaccagaguuguacgcgacaucugaggaacaaaugaccauccucacgcgccugggcaaacagaagaccacauccagcucgaacaaaacuaaguauauugaugaaaaguuacugaccgaggaaaucuacaaucccguuguggccaaaucuguaagacaggcaaucaagauugugaacgcugccauaaaagaguauggggacuucgacaauaucgucauugagauggcuagggaaacaaacgaggaugacgaaaagaaagccauccagaagauucaaaaagcaaacaaggaugagaaggacgccgcuaugcuaaaagcggcaaaucaguacaacggacgugccgaacucccucacuccguguuucauggccacaagcagcuggcuacuaaaauccggcuuuggcaccagcaaggugagcgaugcuuguauaccgggaagacaauaucaauccaugaucugauuaauaacccaaaucaguucgagaucgaccacauucucccgcugaguaucaccuuugaugacagccuugccaacaaaguucugguguacgcaacugccaaucaggaaaagggccagagaacgcccuaccaggcuuuggauuccauggacgaugccuggucuuucagggagcucaaggcauuuguccgcgaaagcaaaucacugaguaacaagaaaaaggaguauuuacugacagaagaggacauaucccgguucgaugugagaaagaaguuuauugagaggaaucuaguagacacccgcuacgcgagccgaguugugcucaacgcucugcaggaacauuuccgggcccacaagacugacaccaaagucucugugguccguggacaguuuacaucacaacuuagaaggcauuggggcaucgagaagacccgcgauacuuaucaccaccaugcaguggacgccuugauuaucgcugccaguagccagcugaaucucuggaaaaagcagaaaaacacacugguuaauuacuccgaaaaccaguuacuggauauagagacgggggagcuuaucucugacgaugaauauaaggagucgguguucaaggcaccuuaccaacacuucguagacaccuugaaaagcaaggaauuugaggauuccauucucuucucauaucaggucgacaguaaauuuaaucggaagaucucugaugcuacuauuuacgccacaagacaggcgaaagugggaaaggacaaaaaggaugaaaccuacguucuggguaagaucaaagacauauauagccagacaggcuacgaugccuucauuaagaucuaucaaaaagacaaguccaaauuucuaauguacaggcaugacccacagacuuucgagaaggugaucgagcccauucuggaaaacuauccuaacaaggagaugaaugaaaaagggaaggaggucccauguaaccccuuucucaaauacaaggaggaacacggagauuauauccgaaaauacucaaagaagggcaaugguccggagauuaaaagccugaaguacuaugacucuaaacuugggaaccacauagauaucaccccuaaggacuccaauaacaaagugguauugcagagugugagccccuggcgcgcugauguuuacuucaauaagacgaccggcaaguaugaaauucugggauuaaaauacgcagaccuccaguuugagaagggcacagggacuuauaaaaucucucaagaaaaguacaacgucauuaaaaagaaggagggaguggauuccgacucagaguucaaauuuacccuguauaagaaugaucuucuguugaucaaagacacagaaacuaaggagcagcaacucuuccgguuucugaguagaaccaaaccaaacgugaagcauuacgucgaacuaaaaccuuacgauaagcaaaaguucgaggguaaugaaagccugauaaacguucucggcgccguggcuaaagggggacagugccagaagggcaucaauaaacccaacauuucgaucuauaaggugaggacggacguacuggguaaucagcacauuaucaaaaacgagggggacaagccaaaacuugauuucuga

SEQ ID NO: 2811 - RNA, 3387 nt, Artificial Sequence
  Cas9 variant
auggacgagaagauggauuacagaaucggccuggacauugggauagccagcgugggaugggcuguccuccagaacaauuccgaugacgaacccguuaggaucguggaucuugguguacggauuuucgacaccgcagagaucccuaaaacaggcgaaucucuggccgggccacgccgagcggcucguacuacgagaaggcgguugcgcagaaggaagcaccgguuagaucgcauuaaauggcuguuugagaaccaaggacuaaucaauauagacgauuuccucaagcgauauaacauggccggccugccggacguguaccagcuuagauaugaagcacuggauaggaaauugaccgacgaggagcucgcccagguccugcugcauaucgcuaagcaccgggguuuucguucaacacgcaaggcagaaacugccgcuaaagagaauggggccgugcucaaggcgaccgaugaaaaccagaaaagaaugcaagagaagggauacaggacaguuggcgagaugauuuauuuagacgaagcauuccggaccggcugcaguuggagcgagaaaggguacauccugacuccccgaaauaaggccgaaaacuaucagcauacaaugcuucgcgcuauguugguggaggaagucaaggagaucuuuuccucucagagaaggcugggaaaugagaaagccaccgaagaacuagaagagaaguaccucgaaauuaugacgucgcagcggucauucgaccuggguccuggcaugcaaccagaugggaaacccagcccuuacgcaauggagggauuuagugaccgcgugggcaaguguacuuuccuuggugaucagggggagcugagaggagcuaaaggcaccuauacagccgaauacuuuguagcguugcagaagauaaaccacacuaaacucguuaaucaggacggcgagaccaggaacuucacagaagaggaacgucgggcccugaccuuacugcucuuuacgcaaaaggaggugaaguaugcagcuguccgaaagaaacuugggcugccagaggauauuuuguucuacaaucuaaacuauaaaaaggccgcuacuaaagaagaacagcagaaggaaaaucaaaacacagagaaggccaaauuuaucggaaugcccuacuaucaugacuacaagaaaugccuggaggaaagagugaaguaccucaccgagaacgaagugagggaucuguucgacgagauugguacuauccuuacauguuauaaaaaugaugacucccgcaccgaacggcuggcaaaguugggccucgucccuaucgagauggaggggcuguuagccuacacgccaaccaaguuccagcaccugucuaugaaagcuaugagaaacauuauaccguuucuagaaaagggaaugacauaugauaaagcgugcgaggaagcaggcuacgacuucaaggccgacagcaaagguaucaagcagaagcuccugacuggggagaaaguuaaucagaccauuaacgaaaucacaaaucccgugguaaagagguccgugucacaaacugucaaagugauaaacgcuauuauccgcaccuauggcaguccucaggccaucaauauugagcuugcacgagagaugagcaagacauuugaggagcggcguaaaaucaagggagauauggagaaaagacagaagaacaaugaggacguuaagaaacagauucaagaauugggcaagcugucuccaaccgggcaggauauacucaaauacaggcuguggcaggagcagcaaggaaucuguauguauuccgguaagacuauuccccuugaggaacuguucaaaccuggcuacgacaucgaucacaucuugccauacucaauuacguuugacgauagcuuccgcaacaaggugcucgucacaagucaggagaaucggcagaaggggaacagaacccccuaugaauacaugggaaaugacgagcagagguggaacgaguuugaaacucgagugaaaaccacaauacgcgauuauaagaaacaacagaagcugcugaaaaagcauuucucugaggaggaacgguccgaauuuaaggagagaaauuuaaccgacacuaaauacaucacaacgguaauuuauaacaugaucaggcagaaccuagagauggccccgcucaaucguccugaaaagaaaaagcaaguucgcgcugugaacggcgccauuaccgcauaccugcggaaaagauggggucuuccccagaagaauagggagacugauacacaccaugcgauggacgcugucgugaucgccugcuguaccgaugggaugauacagaagaucagccgauauacaaaaguccgggaacgcugcuacucgaagggcacugaguucguggacgcagaaaccggagagauuuuuagaccagaggacuacucuagggccgaaugggaugagaucuucggcguucacauuccuaaacccugggaaacguuucgggcugaguuggacgugcgaaugggggaugacccaaagggauuccuggauacccacuccgacguagcccucgaacuggauuaucccgaguacaucuaugagaacuuaagaccuauauucgucucacgcaugccaaaucauaaagugacaggugcagcucacgccgacacuauuaggaguccgcgucauuuuaaggaugaaggcaucguucugaccaaaacagcgcuuacugacuugaagcucgauaaggacggggagauugauggauacuauaacccccagagcgaccugcuacuguacgaagcccucaaaaagcaacugcuuuuguauggcaaugacgcuaaaaaggcauucgcccaggauuuucacaaaccuaaggcugacgguaccgaggggccagugguccggaaggugaaaauccagaagaaacagacgaugggcguauucguggauuccggaaacggcauagccgagaaugggggaaugguuagaaucgacgucuuucaugugaacggcaaguacuacuucgugcccgucuauacagcagauguugugaaaaaggugcugccuaauagggcggccaccgcucacaagccauacggugaauggaaaguaauggaggacaaggacuuuuuauucucucucuauagccgcgaucugauucacaucaaaucaaagaaagauauucccaucaagauggucaacgggggaauggaaggcauaaaggagacuuacgccuauuacauuggugcagacaucagugcugccaauauccaaggcauugcacaugauucccgauauaaauuuagagggcuuggaauccagagccuggacguguuggaaaagugucagauugacguucucggccacgugucugucgugcggucagagaaaaggaugggguucaguuga

SEQ ID NO: 2812 - RNA, 3387 nt, Artificial Sequence
  Cas9 variant
augagcgaccuggugcucggccuugauaucgggauuggauccgucgguguuggcauacugaacaaggugaccggggagaucguacacaaaaaugccagaauuuuccccgcugcacaggccgaaaacaauguggagaggcggacaaaccgccaaggacgacguuugacuagaaggaagaaacaucggcgcgucagauuaaaucacaucuuugaagagucuggccugauuacggacuucaccaaggugucaaucaaccuaaauccuuaccagcucaggguuaaaggucugacagaugaacuuaguaacgaggagcuguuuauagcguugaagaauauggugaagcaucgggggaucagcuaucucgacgaugcuuccgacgauggaaacucuucggucggcgacuacgcccagauugugaaagaaaauucaaagcagcuggagacuaaaaccccaggccaaauccagcuggaacgcuaucagaaguacgggcagcuccgaggagauuucacaauugaggaggacgguaaaaagcacagauuaaucaacguauuuccgaccagcgcauauagggccgaagcucugcggauacuucaaacucagcaggaguucaauccccagauuacagaugaauuuaucaacaguuacuugcaaauucugaccggcaagcguaaauauuaccaugggccuggaaaugagaagucccgcacggacuacggcagauauacuaccaaaaaggauucugaagacgaguacaucacacuagacaacaucuucgguauucucauagggaaaugcacuuuuuauccagaggaauacagggcagccaaggcuagcuauaccgcccaggaguucaaccugcuuaaugaucugaacaauuugacaguucccaccgaaacgaaaaagcucuccgaggaacagaagaaccaaaucauuacuuacgugaaaaaugagaaggcgaugggaccugcaaaacuguuuaaguauaucgccaaauuacuggcuugugacgucgccgauauaaagggcuaccggauugacaagucagauaaaccagagauccacacauucgaagcauaccgaaagaugaaaacccucgagacuaucgacguggaacagauggagcgcgaaaaacuugauaaacuggcuuauguguugacacuaaacaccgagagagagggcauucaggaagccaucgagcacgaauuuagugacgggacguucagccaggagcaagucgaugagcugguucaguucaggaagucuaauuccucaauuuuuggaaaggguuggcauaacuucagcgugaaacucaugauggaacugauacccgagcuuuacgcgaccagugaagaacagaugacaauccugacucgguugggcaagcagaaacgcaccucuuccagcaauaagacaaaauauauugacgaaaagagacucacugaggagaucuacaacccuguaguggccaagucggucaggcaagcaaucaaaauugugaaugcugccauaaaggaauauggggauuuugacaacaucguuauugagauggcucgugaaaugaaugaggacgaugaaaagaaggccaucaaaaagauucaggaggcaaacaaaucugagaaggacgccgcuaugcggaaggcggcaaaucaguacaacggaaaagccgaacugccacacuccguguuccauggccacaagcaguuagcuaccaaaauccgacuguggcaccaacagggugagagaugccuauauacagggaagaccauaucaauccaugaucucauuaacaauccgaaccaguuugaaaucgaccacauucugccccuuaguaucacuuucgaugacagcuuggccaauaaaguccugguguacgcaacggccaaccaggagaagggccaaaggacaccuuaccaggcucucgauuccauggacgaugccuggucuuuucgcgaacugaaggcauucguacgggagagcaaaacccuuucaaauaagaaaaaggaguaucuguugacugaagaggacauaaguaaauuugauguuagaaagaaguucauugaaaggaaccucguggacacccgcuacgcgucccgagucgugcugaaugcuuuacaggagcauuuucgggcccguaaaaucgauacaaaggucagcgugguuagaggacaauucaccucucagcugaggcgccacuggggcauugacaaaacucgggacacauaucaucaccacgcaguggaugcccuaaucauagcugccucaagucagcucaaccuguggaagaaacagaagaauacgcuuguaagcuacuccgaggaccaauugcuggauaucgaaaccggggagcucauuucugacgaugaauauaaggagucggucuuuaaagcaccauaccagcauuucguggacacuuuaaagagcaaagaguucgaggauuccauccuguuuucauaucagguugacaguaaguucaacagaaaaauuucugaugcuacaaucuacgccaccaggcaggcgaaggugggaaaagacaagaaggaugagacauacguccuggguaaaauaaaggacauuuauagccaagccggcuacgaugcuuuuaucaaaaucuaucagaaggacaaauccaaguuccuuauguaccgacacgacccccagacuuuugaaaaggugauugagccuaucuuggaaaauuauccaaacaaagagaugaaugaaaaggggaaagagguacccuguaacccguuccucaaguacaaagaggaacauggagauuauauucgcaaguacucaaagaaaggcaaugguccugagauaaagagccugaaauacuaugacucuaagcuagggaaccacaucgauauuacccccaaaaacuccaauaacaaggugguucugcagagugucagcccauggcgggcagacguguacuuuaauaagacgaccggcaaauaugaaauccucggacugaaguacgccgaucuucaauucgagaaaggcacagggacuuauaagauuucucaggaaaaauacaacgacaucaagaagaaagagggaguggauuccgacucagaguuuaaguucaccuuguauaaaaaugaucuguuacucauaaaggacacagaaacuaaagagcagcaacuguuuagauuccuuaguaggagcaugccuaacaagaaacacuacgucgaacugaagcccuacucgaaggauaaauuugagaagaaugagaccuugaucgaaauucucgguccaacggacaaauccggccguugcaucaaggggcuggcuaaaucuaaccuaagcauuuucaagguucgcacagacauccugggaaaucagcauauaauuaagaacgagggcgauaaacccaagcucgacuucuga

SEQ ID NO: 2813 - RNA, 3387 nt, Artificial Sequence
  Cas9 variant
augaccaagauccugggccucgaccuugggacaaacagcauuggaugggccguggucgaugagaaaaaggagaaaauacuggguaugggcuccagaaucuuccccgaagggguugugaauauuggagaaggcgaggguagggaaacuucuaagaacgcuucacggacggacgcacgcgggacccgacgucaguuuuucagaaggcgguugcgcaaaagauacuuacugagggagcuagccaagaagggacucugcccuaucaauuauacacugguaaaagaguggaacgaagcgcaaauuuuuaagaauaaacagcuucaggagugguucaagcugaacccauacgaauugcggaguaaagcuauccaggagaagauaagccucgaggaacugggccgcaucuuuuaucacuucauucaacgaagaggcuuucaguccaauucuaggucggccgggguggauaacaucgagaagucagucauuuucaaaggagacacuaagaccgguaaaaucggcauaagcgaaacacuggagaguauuaagaauaccaaaacucucggguccuacuuacauacaaucuauccgaagcagaacaaacccuacucuggacacaaggaacggauucguaaucgcuauaccacgagacagauguacaucuacgaguuugagacuaucugggaauaucaaaagcaguucuacagcgagcuguccaacgaacuuaaaaccguguugggcgguaggaagaaagauggguauaaggaggacgggauucuguuucaucagcggccucuacgaucacagaaacaccucguuggcuacuguaguuucgaaccaaagaagacaaaaugccaaauaaauacuauccccuuugagcuguuccgcauuuaucagugggugaacaccgucgauuguaaugagaaggugacaagcgaagacagaggcaaaaugguagagcuucuguugucuaaggaaaaaguuuccuucaaggagaucaggaaggugauaaacaaaucagauggguacuaucaguuuaacuacaagaaugacgauaaaauugucggaagcuacaccaucaguaaccucucuaauaagaaauucuuugguaagaagugguucgacuuuuccgauaaagaacaagaggacaucuggcaugugcugagcuucuuugacgaucgggacaaguuaaaacaguaugcaauuaaguacuggggcuucaacgaggaaaaagccgugaagaucucgaaauuuaaucugaaggagggguauucuaaccucucccgcaaggcuauucacaauauacuuccuuuccugaaauugggauuuauguacgaugucgcaguuggccuagguggggugaagaacgcccuggcugacaaauggaucgaaaaugagcaguucauucucgauaacguaccaucaguggucagaaguaauuuuaagggcggauauaucgagccccugaaacagaugcuuaaguacgaguucgacgugagcgauaagcaacuguugaaacucuaucaccauuccucugccaucgaaacgacugaacuguuaaagaaacugccuauuaacagcgaggcggacaaggaaauacagucaaucaaaaauccaguugugauuacagcacuauucgagaucaggaagcucgucaacgagauuaucgauaccuacggcaaguuugacgaaauaaaaguggagcuggcccgugaucuuaaggcuaguaaauccaagcgguacgacacucgaagagaacaguugaggcuggagaaagaaaaugaccgcaucaagauugagcucgagaaccuggggcagcggaucaaccacauuacaauccuuaaguauaaacugugggaagagugcgauaagagauguccguucaccgguaaaaauauagaaguaaacgaguuguuuagcggagaaguucaaauugagcauaucuuccccuggucuaggucacucaaugacaguuuuaugaacaagacgcugugcuucgccgaugagaaucgcgcaaaaggcaacaagaccccuuacgaauuuuauagcgagcagggggaacagaaaugggaggagauuaagauccaggcuuuauccuguuucaagaauaaaccaaacuaccccaaugccuaucaaaaguuuaaacaguucgugaagaaaaagcacgacgaagauuuuauaucucgacagcugaacgacacacgguacaucucgaaggaggcgaaaaauuaucuaagcaagauuugcaacaauguccagguggccccuggacaaaugacugcaacccuccgucacaaauggggccugaacacaauccuuaauaaggaugacgauacuaaaaccagagacgaucauaggcaccaugcuauugacgccuuggucauggcuuguuccacacgcucacaucugcaggaacucaguaagcggaacagauaccagaaggauuacgaguucaaagacuuuccaaugcccuggcaauucuucaggcaggacgccgaaaagucuguggagcagauccugguuagccacaaaaaguuaaacaccauacugacugugcgaacgcacaaaacaaagaagaaugguguagucuauaaaaacauugggguggcagcccgcggccagcuucacaaggagaccguuuuuggaaaacggacugcuccggauggcaucgaagcguaccaugugagaaagccuaucgaguccuugucaacccacaaacauauuaauaaggucguggacgaaacaaucaggcuccugauucuaaagcaaguaaacaaacugggaggauucgugaaggguaaaauacccgagggcaccuuuuauaauacugaugaaaacgggaauaagcagccacagaucuuccucccuaacaaaaauggaaaccccguuccaauuaagaaaauccgucugcgcgagaauauuggcggugcagagcagcuuaagagcacagucaaccaacacgugaauccccggucuaaccaccauguguugaucuacaaggacuuugaugacaaucugaaagaaaaggucguuacguucuggaccgccguggagaggaaaaagcagaaacaggcuguguuucaguuaccugaaaacgggaaggagauaguaacuacacuccaaaucaacgauauguuccugcuuggccugaaggacgaugaaauuaauugggagcacccaaaauuuaccuugcucaaggagcaucuguauagaguccagaaauucacauccggagacuacuauuuucgaaagcacaucgaaaguaaccuaaauggcgagcuggggaaagccuaccaguacauuaagggauucggcgaagguaagacuggguggaaaaccuucaacccgaucaagauaaaagugagcguuucuggaaagauugagaaaguguga

SEQ ID NO: 2814 - RNA, 3390 nt, Artificial Sequence
  Cas9 variant
augaacggccuggugcucgggcuugacaucggaauugccagcgucggugcuggcauacugaagaaagauaccggggagaucauucacgcaaauuccagauuguuccccgccgcgacagcugacaacaauguuuuaaggcggucuucacgccaggcccgacguaguacuagaaggaagcggcaucgcgcagugagacugcacgaucuauuugaagacuacggacuccugacggauuucagcaaaguauccaucaaccuuaauccuuauaagcugaggguggagggcauggacauucaauugaccacagaagaacucuuuaucgcccugaaaaacauaaucaagcggcgcgguauuucuuaccuggaugacgcuucggaagauggggucacugugucaagcgacuauggaaaggcaguugaggagaaucgaaaacucuuaagugaacagaccccaggccagauccagcuggagagauucgaaaaguacggccaagugaggggagauuuuacagucgaggagaacggggaaaaacggcgucuuauuaauguguucuccaccucuacuuaucgcaaggaggccgaaagaaucuugaggaaacagcaggaguuuaacaauaagauaacagacgauuucauugacgacuaccugaccauccuaacggguaagcggaaauauuaccauggcccggggaacaagaaaagccgaacugauuacggacgcuauaccacaaagaaagacuccgaaggcaaguacauuacucucgauaauaucuuugguguacugaucgggaaaugcaccuucuaucccgacgaguacagagcuucaaaggccaguuauacagcgcaggaguuuaaccuucugaaugauuugaacaaccucaccguuccuacggaaacuaagaaacugagcgagaagcaaaagaagacaauuguggaauacgcaaaaaccgccaagacuuuaggagcuucuacacugcucaaguauauagccaaaauggucgacgcauccguggaucagauccacggcuacaggguggacgucaauaagaaaccagagaugcauaccuucgauguuuaccggaagaugcagucacuugaaacguuuaacgugaaugagaugccccgcgagguacuggacgaauuggcucacauucuaacccugaacacagagagagaaggcaucgaggaagccauaaauacuaaacucaaggggaccuucaaccaggaucaagugcuggagcuuguccaguucaggaagaauaacagcagucuguuuucuaaaggauggcacaauuucuccuugaagcucaugauggagcugauuccugaauuauaugcgacaagcgaggaacagaugacuauccugacccgucuagguaaacaaaagucgaaagagaucucuaagcggacaaaguacauugacgagaaagaaaucaccgaggaaauuuauaacccagugguugccaaguccgugcgacaggcaauaaaaaucauuaaugaggcuacuaagcaguacggcaucuuugaccauaucgucauugaaauggccagacucacgaacgaggaggaugcuaaaaaggacuauauaaaaaggcagaaggccaaucuggaugaaaagaacgcagccauggagaaagcugcguuccaauacaaugggaagaaagaacuucccgacucaaucuuucacggacauaaggaguuggcaacaaaaauucgccuguggcaccagcagggcgaaaagugucucuauaccgguaagaacaucccuauuagugaucugauccagaaccaauacaaauacgagauagaccacauccuuccacugagcuuguccuucgaugacucucucagcaauaaggugcugguauuagccacugcuaaccaggagaaagggcagcggaccccguuucaggcccuggauagaauggacgaugcauggucauauagggaguucaagaguuacguuaaagacuccaagcuacucggcaauaagaaaaaggauuaucugcuuacagaggaagacauuagcaaaaucgaggugaagcaaaaauuuauugaacgcaacuuggucgacacccgauacucuucacgggugguccugaaugcccuccaggauuucuauaagaaccaucacuuugacacuacaaucagugugguucguggacaguucacgagccagcugagaaggaaguggggcuuagagaaaucccgcgagaccuaccaucaccaugcuguggaugcccugauaauugcagcgucuucgcaacuucgguuguggaagaaacagaauaacccccucaucuuuuauaaggaagggcaguucguagacagcgagacuggagaaauucugucccuaaaugaugacgaguacaaagagcuggucuucaaggcuccuuacgaucacuuuguggacacacucagaucaaaaaccuucgaagauaguauccuguuuucuuaucaaguugacagcaaguacaacaggaagauauccgaugccacaaucuaugcaacucgaaaagccaaacuugacaaagauaagucaaaagagaccuacguguugagcaagauuaaggacaucuauucucaggcugguuacgacgccuucauuaaaaucuauaauaaggauaaauccaaguuucugauguaccacaaagacagucagacguucgaaaaggucauagaggaaauuuuacgcaccuacccaagcaaggaguuuaacgauaaaaauaaggaggugcccugcaacccuuucgaaaaauaucggcaggagaauggcccaaucagaaaguacucuaaaaaggggaacggacccgaaaucaagucccucaaauauuacgacaagaacauuccggagucauuuaucaauauuacaccuaguaacagcaaaaauaagguaauacugaggcaacuuaaccccuggcguacugauguguauuucaaucaucagaccgaaaaauacgagcuguugggccucaaguaugcagaccugcaguuugagaagaaaacagguacuuacucgaucaccauugauaaguacaacgaaaucaaagagaaggaagggguuggcgagcaguccgaguucaaauuuacgcuauauaagaaugaccugcuccugauuaaagauacaaagaacaaugaaaagcaaaucuuccgcuuccuuucucggaccaugccaaacgucaaacacuacguggaguugaagccuuauaauaaagcuaaguuugacggaaaccagccccugauaacuaucuucggcaauguggccaaagggggacaguguuuaaagggucucaacaagccaaauauuagcaucuacaaaauuaagacagauguccugggcaacaaauauuuuaucaagaaagaaggggacaagcccaaacuuaaguucuga

SEQ ID NO: 2815 - RNA, 3390 nt, Artificial Sequence
  Cas9 variant
auggccgacagaaucagccugggccucgauauugggguggcuuccgucggauucucuguucuugacauagauaaggguaaagugaucgagcugggcucaagguuguuuaacgcaaccguagccgaagggaaucaggaccggcgcaguaugcgaggagcgcguagauuacugaacaggaauaagcaacggcgccaggauacaggcaaacuauuccagaaguuuggucuccuggacaacuucaauaaagauaacuuuuacgacacuuucaaucagaacuggaaucccuaugagcuuagagugaaggggcugacggaacacuugaccaagaaagagcucgcugaaagccuguaccaaauugucaagcauaggggaaucuccuaugcccugaaagaugcagacgccgaugagggcggcacagacuacucugcuucgcucaagauuaacucacaggaguuagcagagaaaacuccugcccagauccagcugcaacggcuuaaugauuaugggaaggugcgcggacagguugugauaggugacgacccagauaaccagaaggucuugcugaauguguuuccgaccagcgcuuacgagaaagaagccaagcagaucauugcgacacaaaaacaguucuaucccgagauccuaaccgacgaguuuacuaaggaauacugcaaaauucucacacgaaagagagauuacuucguaggcccugggaacgagaaaaguaggaccgacuauggaaucuacaagacggauggccggacucuggacaaucuuuuugaagaacugauaggucacgauaagauuuauccagacgaauugcgugcauccgccgcuucuuacaccgcccagcucuuuaacguucugaacgauuuaaauaaccugcgcauccucagcuaugaggacgggaaacuuacaaaggaggauaaagaaaagauuaucgcagagaucaaauccaauacuaccacaauuaacaugcugaaugugauaaagaaggucgcuggauguucaaaagaagacaucaagggcuuuagagugaacgagaaagacaagcccgaaauuaguagcauggccguguacaggaaaguccauaaggauuugcuaaagguuggcguggacaucucugauuggccuguagaguucauagacaaacuguccuucauucucacccugaauacggagaacggggaaauccggaagcaacuuaauaaccgacuggugccagaguuugauuucuugaaugacgaucucauccagcugauuaucgacaacaaagauucauuugaaauuaagacuaauaacaaauggcaccgcuucagcuuaaagacaaugaauaagcugaugcccgagaugcuagaaagaccugucgagcagaugacccuccugaacgagaugggacuugugaaaaaggacaaaaagagguuugaaaacaauaaauauuugccauacaaggagauagcgaaagauaucuucaacccgguugccaguaagucugugcgggaagcacugaagauugucaaugcugugcucaaaaaguacggucauaucgacuaucugguaaucgagaugccccgcgauaaaaaccuuaaggaggaacaggacaauauuaaagaguuucaaaacaagaauaagaaagccaaggacgcugccuucgaagcauuuguuaaauccgugggcagcgagcagagagucaaggaagcccugucgaaaaacaggaaguugcagaugaagaugcgucucugguaccagcaacaggagauagauccuuauaauggggagacuaucgacgcuacagaucugauuaacaauccagacaaauucgaaaucgaucacauuaucccccagucuauauccuuugacgauucaaucaacaauaagaccuuaugcuucgcgaguaugaaccaggugaaaggacaaaagacgccuuacgaguuuaugcuggaaggccacggucagggguaugacaaauucaaggcaaccguccuagauaauaagaacuucgaccggaacaaacgaaagaauuaccucuuugaggaaaacgugagcgauauugagacaagaaaaagguuccugucccgcaaucuuguugacacucgguauucuagcagagugguauugaacucacugcaggauuucuuccaugagaagagugccgacaccaaagucacagugaucaggggcaaguuuacuuccaauaugcgcaaacacuggcauauugacaagacccgagaaacauuccaccaccaugcuaucgaugccagcauaauugcagccaccccauuucuccggauguggaagaaaggaggcacuaucuuccccguuaaggugggggaggaaucuauugacaucgagacgggagaaauacuggaugacaaaaaguuugauaaagucauguacgaggagccguacaacgguuucgugucagaaaucaugaaugcugacgaucguauuaaguuuagucaccagguagacaagaaaaugaacagaaaggugagcgaugccacaaucuauuccaccaggacuggcaaauuagcaaaggacaaaaaggaugcggaguacauuguugcuaaggucaaagacaucuauucuguggacggguucaagaaauuuaagaaaguguacgauaaggacaagucgaaauuccugcuuuauaaguacgauccucgcaccuucagcgaauuggagcggauaauuuccgacugucccgauaaagucgagaagguucaaacaaauggaaaagugaaggccguggacguaucaccauuugaaauguauagaagguaccauggcaugaucaagaaauacaguaagaaagguaacgggccugcaaucaagcagcucaaauaucuggauaagaaacuaggcucucacauugacaucacccccgccaaugcuaacggaaagcaugucauucugcagagccucaagccauggcgaacugauguguaccugaaucacgagacaggcgaauaugagauaauggggaucaaauacuccgaccuuaaguucaacaaaaauguuggauaugguauuaagaaagauaaguacuuggaaaucaagaaaaacgaggaggugucagaaaagagcgaguuuauguucucucuguaucgcaaagaccgggucaggauucaaaacaugaagacgggcgaauccguggaguuacucuuuuggaguagaaauuucagcaacaaaaaguacgccgaacugaagcccaucuuuaaauucguuaccgaggaugacgacuggccuguguacgggcacgcaaagacucagauacuuaaacgucugguaccaaaggauugcaaaaucuggaaggucaauacaaccauuuugggagacccguauuaccucgagaaggaaucugauaaccccaaagacauccuggauuga

SEQ ID NO: 2816 - RNA, 3390 nt, Artificial Sequence
  Cas9 variant
augaccaacggcaagauccuggggcucgacauuggaauagccagcgugggugucggcaucauugaggcuaaaacagggaagguugugcacgcaaauuccagacuuuucucugccgcgaacgcugaaaauaacgccgagaggcggggauuucgcggcucacgacgucugaauagaaggaaaaagcaucggguaaaacgcgugagagauuuguucgaaaaguacgguaucgucacugacuuuaggaacuuaaaucugaaccccuaugagcuacgggugaaggggcucacggaacagcugaccaaugaggagcuuuucgcagcccugcgcacaauuaguaaacgaagaggaaucagcuacuuggaugacgcugaagaugacuccacuggcucuaccgauuaugcaaagucgauagacgagaacaggcggcuccugaaaacaaagaccccuggccaaauccagcuggaacgucucgagaaauacgggcaguuacgcggaaauuuuacuguuuaugaugagaacggugaagcccacagacugauuaauguguucucaacaagcgacuacgagaaggaagcuaggaagauccuugagacccaggccgauuauaacaaaaagauuacggcggaauuuaucgacgauuacgucgagauauugacucaaaaacggaaguacuaucauggcccagggaaugagaaaagucgaaccgacuacggacgcuucagaacagacggcacuacccuggaaaacauuuuugguauccuaauugggaagugcuccuucuauccggaugaguacagggcaucuaaagccagcuauacagcucaggaauacaacuuucucaaugaccugaacaaucuuaaggugcccaccgagacgggaaagcuguccacugaacagaaagaggccuugguagaguucgcaaagucaacagcuacccucggcccugccaaacuguuaaaggaaaucgcgaaaauccuggauuguaagguugacgagauuaagggcuaucgggaagaugacaaagggaagccagaucuccacacuuuugagcccuaccgcaaacuuaaguucaaccuggacagugugaauauagaugacuugagcagagaaguccuagauaaacuggccgacauccucacacugaacaccgagagggagggaauugaagacgcaaucaagcguaaucuuccuaaccaguucacggaggaacaaauaucugagauuaucaaugugcggaagucccagucaaccgcuuuuaacaaagguuggcauagcuucagugccaagcugaugaaugaguugaucccagaacucuacgcuacaucugaugagcagaugacuauucugacccgauuagaaaaauuuaaggugaaaaagaaguccagcaaaaacaucaagacaauugacgagaaagaaauaacugaugagaucuauaaucccgucguugccaagucggugagacagaccauuaaaaucaucaacgcagccguaaagaaauacggcgacuucgauaagauugugauagagaugccuagggacaagaaugcugaugacgagaaaaaguuuaucgauaaacgcaacaaggaaaacaaaaaggaaaaggacgaugcgcugaaacgggcagccuaucuauacaaugggacagacaagcucccagaugaggucuuccacgaaaacaaacaacuggagaccaagauuagacuuugguaucagcagggagagaggugcuuguacucuggcaaaccgauccccauucaagaacuggugcacaauuccaacaauuuugagaucgaccauauacucccucugucacuuaguuucgacgauagccuggcuaacaagguuuugguguauuccuggacuaaucaggaaaagggucagcgcacgccauaccaggucaucgacucuauggaugccgcauggagcuuucgagagaugaaagacuacgugcucaagcaaaaagggcugggcaagaaaaagcgggauuauuuacugacaaccgaaaacauugacaagaucgagguuaaaaagaaauucauugagcguaaucuaguagauacuagauacgccucaagggugguccucaacagucugcaguccgcccuucgcgaauugggaaaggacaccaaagugagcgucgugcggggccaguuuacaucucagcugagaaggaaguggaaaaucgauaagucacgagagaccuaucaccaucacgcuguugacgcacucauaauugcggcuaguagccaacugaaguuaugggaaaaacaggauaaucccauguucguggacuacgggaacaaucagguagucgauaagcagacuggagagauccuguccgugucugacgacgaguauaaagaacuuguuuuucaaccuccauaccaggguuucgugaacacaauuucgagcaagggcuucgaggaugaaaucuuguuuuccuaucaggucgacucaaaauacaaucgcaaggugagugaugccacgauauacucuacccggaaggcaaaaaucgggaaggacaaaaaggaggaaacuuauguacucggaaaaauuaaggauaucuacagccagaacggcuucgacacauuugugaagaaauauaacaaggauaaaacccaauuccugauguaccagaaggacccccuaacaugggagaauguuauugaggucauccugagagauuauccgacuaccaaaaaguccgaagacgguaagaacgaugugaaauguaauccuuuugaggaauacaggcgugagaacgggcucauaugcaaguauaguaaaaagggcaaaggaacgcccauuaagagccugaaguacuacgacaaaaaguugggcaauuguaucgacaucaccccacaggaaucuaaaaaccgcgugguccuucggcaaauuuccccuuggagagccgauaucuauuucaaucccgagacacugaaguacgaguuaauggggcucaaauauagugaccugagcuuugaaaagggaacugguaaauaccacauuucucaggagaaguaugaugcuauaaaggaaaaagagggcguugggaaggacuccgaguucaaauuuacccuuuacaggaacgaucugaucuugauuaaggacacacucaauaacugcgaacgaaugcugcgguucggaagcaaaaaugauacuucaaagcauuauguggagcuaaagccacuggaaaaaggcaccuuugacucagaggaagagauccuccccgugcuggguaagguagccaaaucggggcaguucauuaagggccuuaacaaaccuaauaucuccauauacaagguccgcacggauguguugggaaacaaguacuuuguuaaaaaggagggcgacaaaccaaagcuggauuucaaaaauaacaagaaguga

SEQ ID NO: 2817 - RNA, 3390 nt, Artificial Sequence
  Cas9 variant
augagcaacggcaagauccuggggcucgacauuggaguggccuccgucgguguuggcauaaucgauucuaaaaccgggaaugugauucacgcuaacucaagacuuuucagugcagccaaugcggagaacaaugcugaaaggcggggauuucgcggcgcccgacgucugacaagaaggaagaaacaucggguaaagcgcgugagagacuuguucgagaaauacgauaucagcacugacuuuaggaacuuaaaucugaaccccuaugaacuacgggucaagggucucacggagcagcugaccaaugaggaacuuuucgcagcccugcgcacaauugcuaagcgaagagggaucuccuacuuggaugacgcagaggaugacucuacuggaucgucagauuaugccaaaagcauagacgaaaacaggcggcuccugaagaccaaaacaccuggccaaauccagcuggagcgucucgaaaaguacggccaguuacgcgggaauuuuaccguguaugaugagaacggagaggcucacagacugauuaauguuuucaguacuuccgacuacaaaaacgaagccaggaagauccuugagacacagucuaauuauaacaagcaaauuaccgaugaauuuaucgaggacuacauagaaauuuugacgcagaaacggaaguacuaucaugguccaggcaacgagaaaagccgaacugacuacgggcgcuucagaaccgauggaacaacucuggagaauaucuuuggcauucuaaucgguaagugcuccuucuauccggaagaguacagggcgucaaaagcaaguuauaccgcccaggaauuuaacuuccucaaugaccugaacaaucuuaaggugcccacagagaccgggaaacugagcacggaacagaaggaguacuuggucgauuuugcuaagaaaucuaaggcccucggagcauccaaacuguuaaaggagaucgcuaaaauuguggacuguucaguagaugacauaaagggcuaucggguugauaacaaggacaaaccugaucugcacacuuucgaaccauaccgcaagcucaaauucaaucuuagcaguaucgacauugaugagcugucuagagaaacauuggacaagcuagccgacauccugacccucaacacugagagggaaggcauagaggaugcgauuaaacguaaucugcccucccaauuuacagaggaacagaucagcgagaucgugcagauucggaagaaccagucgucugccuucaauaagggguggcauuccuuuucagcaaaacuuaugaacgaacugaucccugaguuguacgucaccagugaggaacaaaugacgauucucacccgacuggagaaguucaaagugaauaagaaaagcuccaagaacacaaagacuauagacgaaaaagagaucaccgaugaaauuuauaauccaguggucgcuaagucuguuagacagacaaucaaaaucauuaacgccgcugugaagaaauacggagacuuugauaagauaguaaucgagaugcccagggacaaaaacgccgaggaugaaaagaaguucauugacaaaaagcagaaagagaauaagaaagaaaaggaugacagcuuaaagcgcgcagccuuucuguauaacgguacugauaaucuaccugacggcguguuccacgggaacaaagagcucaagaccaaaauccggcugugguaccaacagggagaaagaugccuuuauucaggcaaguugauuaguauccacgaucugguccauaauuccaacaaauuugagauagaccacauccucccacugagccuuucuuucgacgauucacuggcuaauaagguguugguuuacgcguggacaaaccaggagaagggucagaaaaccccguaucaagugauugacaguauggauacugcauggagcuuuagggaaaugaaggacuacguccucaaacagaaggggcugggcaaaaagaagugugaguacuuacugacgacagaaaauaucgauaaaauugaggugaagaaaaaguucaucgaacgcaaccuaguagacacccgauaugccucccggguugugcucaauucucugcagacugcucuuaaagaguugggaaaggauaccaaagucucggugguccguggccaguuuacaagccaacugagaaggaaguggaacauagacaagucccgcgagaccuaccaucaccacgccguggaugcacucauuaucgccgcuucaagucagcugaaauuauggcagaagcaggaaaaucccauguucgagucuuauggggaaaaccaaguugugaauaaagagacuggagagauucugagcaucuccgacgauaaguacaaagaacuuguauuccagccuccauaucaggguuuugucaacacaauaucaagcaagggcuucgaggacgaaaucuuguuuucuuaccagguggauuccaaguucaaccggaaaguuagugacgccacgauuuauagcaccagaaaggcaaaacucgggaaggacaaaaaggaugagacuuacgugcugggaaagaucaaagacauuuacucucaagauggcuuugacacauucaucaagagguauaaaaaggauaaaacccaguuucuaauguaccagaaggacccccugacaugggaaaaugucauagaggugauucuccgagauuauccuuccgagaagcugucagaagacgguaaaaagacuguaaaaugcaacccauucgaggaauaccgccgggagaaugggcuuaucuguaaguauaguaaaaagggcaacggaacccccaucaagagcuugaaauacuaugauaagaaacugggcaauugcauugacaucacgccggaaaagucgaaaaacagagugguuuuaaggcaaauuuccccuuggcgugcggauauauacuuuaaucucgagacccugaaguacgagcuuauggggcugaaauauucugacuugagcuucgaaaagggaacagguaaguaccauaucucacaggagaaauaugacgcuauucgcgaaaaggagggcaucgggaaaaagagugaauuuaaauucacucucuaccggaacgaucugauucuaaucaaggacacccugaauaacugugagagaaugcucagguuuggauccaagaaugauacaucuaaacacuaugucgagcugaagccccuugaaaaaggcacuuucgacagcgaggaagagauauugccagugcuggguaagguggccaaauccgggcaguucaucaagggcuuaaacaagccuaauauuucaaucuacaaaguccgaaccgauguucucggaaacaaguuuuucauuaaaaaggagggcgacaaacccaagcuggauuuuaagaauaacaacaaauga

SEQ ID NO: 2818 - RNA, 3390 nt, Artificial Sequence
  Cas9 variant
augagcaacggcaagauccuggggcucgacauuggaguggccuccgucgguguuggcauaaucgaugcuaaaaccgggaaugugauucacgcaaacucuagacuuuucucagccgcgaaugcugagaacaaugccgaaaggcggggauuucgcggcgcacgacgucugacaagaaggaagaaacaucggguaaagcgcgugagagacuuguucgagaaauacgauaucaguacugacuuuaggaacuuaaaucugaaccccuaugaacuacgggucaagggucucacggagcagcugaccaaugaggaacuuuucgccgcucugcgcacaauugcaaagcgaagagggaucagcuacuuggaugacgccgaggaugacuccacuggaucuucggauuaugcuaaaucaauagacgaaaacaggcggcuccugaagaccaaaacaccuggccaaauccagcuggagcgucucgaaaaguacggccaguuacgcgggaauuuuaccguguaugaugagaacggagaggcccacagacugauuaauguuuucagcacaagugacuacaaaaacgaagcgaggaagauccuugagacucaguccaauuauaacaagcaaauuaccgaugaauuuaucgaggacuacauagaaauuuugacgcagaaacggaaguacuaucaugguccaggcaacgagaaaucucgaacugacuacgggcgcuucagaaccgauggaacaacucuggagaauaucuuuggcauucuaaucgguaagugcagcuucuauccggaagaguacagggcauccaaagccucauauaccgcucaggaauuuaacuuccucaaugaccugaacaaucuuaaggugcccacagagaccgggaaacugaguacggaacagaaggaguacuuggucgauuuugccaagaaaagcaaggcacucggagcuucuaaacuguuaaaggagaucgccaaaauuguggacuguuccguagaugacauaaagggcuaucggguugauaacaaggacaaaccugaucugcacacuuucgaaccauaccgcaagcucaaauucaaucuuucaagcaucgacauugaugagcugaguagagaaacauuggacaagcuagcggacauccugacccucaacacugagagggaaggcauagaggauacaauuaaacguaaucugcccucucaauuuaccgaggaacagaucuccgagaucgugcagauucggaagaaccagagcucggccuucaauaagggguggcauucuuuuuccgcaaaacuuaugaacgaacugaucccugaguuguacgucacgucagaggaacaaaugaccauucucacacgacuggagaaguucaaagugaauaagaaaaguagcaagaacacuaagaccauagacgaaaaagagaucacagaugaaauuuauaauccaguggucgcuaaguccguuagacagacuaucaaaaucauuaacgccgcugugaagaaauacggagacuuugauaagauaguaaucgagaugcccagggacaaaaacgccgaggaugaaaagaaguucauugacaaaaaggagaaagaaaauaagaaagagaaggaugacucuuuaaagcgcgcagccuuucuguauaacgguaccgauaaucuaccugacggcguguuccacgggaacaaagaacucaagacaaaaauccggcugugguaccagcaaggagagagaugccuuuauagcggcaaguugauuucaauccacgaucugguccauaauaguaacaaauuugagauagaccacauccucccacugucccuuagcuucgacgauucucuggcuaauaagguguugguuuacgcguggaccaaccaggaaaagggucagaaaacuccguaucaggugauugacucaauggaugcagccuggaguuuuagggagaugaaggacuacguccucaaacaaaaggggaucggcaaaaagaagcgcgaauaccuguuaacgacagagaauauugauaaaaucgaagugaagaaaaaguucauagagcgaaaccugguagacacccgguaugcuagccguguugugcuaaauucccuccagacugcccugaaagagcuuggaaaggauaccaaagucucuguggucagaggccaguuuacaucgcaguugaggcgcaaguggaagauugacaaaagccgggaaaccuaccaucaccacgcaguggaugcccugaucauugcugccuccgggcaacucaagcuguggcagaaacaugagaacuuaauguucgaaaauuauggagagaaccagguugugaauaaggagacuggugaaauccugucaauaagugacgaugaguacaaagaacuuguauuccagcccccuuaucaaggcuuugucaacacaaucucuagcaagacguucgaggacgaaauuuuguuuuccuaccagguggauucaaaguucaacagaaaaguuagcgacgcaaccaucuauucuacuaggaaggcgaaacucgggaaggacaaaaaggaggagacauacgugcugggaaagauuaaagauaucuacacccaggacggcuuugauacauucauaaagcgauauaaaaaggacaaaacucaguuucuaauguaccaaaaggauccacugaccugggaaaaugucauugaggugauccuccgcgacuaucccuccgaaaagcugagugaggaugguaaaaagacgguaaaauguaacccuuucgaagaguaccggagagagaaugggcuuaucugcaaguauagcaaaaagggcaacggaaccccaauuaagucuuugaaauacuaugacaagaaacugggcaauuguaucgauauuacacccgaaaaguccaaaaacagggugguuuuacgucagauaucaccguggcgcgcugacaucuacuuuaaucucgagacucugaaguacgaacuuauggggcugaaauauagugauuugagcuucgagaagggaaccgguaaguaccacauuucgcaggaaaaauaugacgccauccgggagaaggagggcauugggaaaaaguccgaauuuaaauucacacucuacagaaacgaccugauccuaauaaaggauacucugaauaacugcgagaggaugcuccgauuuggaucuaagaaugacaccagcaaacauuaugucgaacugaagccucuugagaaaggcacguucgauucagaggaagagaucuugcccgugcuggguaagguggcaaaaagugggcaauucauuaagggcuuaaacaagccaaauaucuccauuuacaaaguccggacagacguucucggaaacaaguuuuucaucaaaaaggaaggcgauaaaccuaagcuggacuuuaagaauaacaacaaauga

SEQ ID NO: 2819 - RNA, 3393 nt, Artificial Sequence
  Cas9 variant
augaacaagauccugggccucgaccuugggaccaauagcauuggaugggcccugauagagaacaauaucauuuuggguaugggcuccagaguguuccccgaaggggucguuaacuuaggagagggcgaagguagggagacaucuaaaaaugcuucacggacugaagcacgcggggugcgacgucagaucuuuagaaggcggcugcgcaagagauaccuacucaaagagcuggccaagcacaaccuuugcccuauuaguccaacgcugaucaaagauuggaauggaaccgacauauucaagaacgaguugaucauucaaugguuucagcucaauccguaugaacugagggcgaaggcuauccaggaggaaauuacacugaucgagcucggccggauauucuaccauaugauucagcgccgaggcuuuuuaagcaacuccagaucugccggggcagauguaaaagagacuucgaccaucuucaagggagacgccaaaauugguaagaucggcaucucagauacacugaaaagcauugaacaaaauaagacccuugggaguuuucuacacuccauacagcccaaggagaacgaaccuuucucuggagagcuggaaaggauccggaaucguuauacuacacgccagauguacauugacgaguuugagaccaucugggaguuccagaaacaauaucauagcgaacuaaacuccaaucucaagacgauacugggcgguagaaagaaggauaacuacaaagaagacggggugcuuuuucaccagaggccacugcggucacagaagcauuuggucggauucuguaguuuugagcccaaaaagacuaagugcaaacucagcgcuauuccuuucgaacuguuccgaaucuaucagugggugaacaccuuaucuuacgauguuaauggcgugcgccaaaagaucacacaggaggagaggaaaaagauuaucgaccugcuccuuuccaaagaaaagccaucauuuaaggagauuagaaaagcaauaggcaagcuggaugggagcuaccaguucaacuauaaagacgaugacaagaucgucggaagucacacuauuucuaauuuguccaacaaaaaguuuuucgguaauaagugguuugacuucagcgaaaaagagcaagaaaacaucuggcacauccuaucguuuuucgaugaccgggagaagcugaaagaguacgccauuaagaauuggucuuuugaugaggaacgcgcugugaaaauauccaaguucaaccucaaggacggcuauucaaaucugaguagaaaagccauccuuaacauucugcccuuuuugcagaagggguucauguacgauguagcgguuggacucgcaggcgugaaaaauacccugagcgucaacugggaggaacaugagcaguuuguguuagacaaugugccugaaaucgucagguccaaccugaaggguggguauauugagccauugaaaaauaugcucaagaacgaguucaacuguaaugauaaacagcuggaaaaacuuuaccaccauucuagcgccaucgaaacagagaacauauuggaccgucugccgguuaaucuccacgcugaucgggagauccaaaagauuaaaaaccccgugguaaucaccgcccuguucgaaauucgaaaacuugugaaugaggucaucgacacguauggcaaaccuaacgaaauaaagguggagcuggcaagagauuugaaggcuucaaagaguaauaggcucgaagcccgcaagcggcagaaagaccuggagaagcagaacgacagaguuaaauuagagcuggaaaaucuaaaccagagguccaaucacauuaacauccucaaguacaaacugugggaggaaugcaaucauacuuguccauuuacaggacaaauuaucaccauaagccagcuuuucacuggcgaggugcagaucgaacacauuuuucccuggucucgcucauugaacgauaguuucaauaacaagacacugugcuuugcggacgagaaccgagccaaggggaauaaaaccccuuacgagcucuauagcgaacagggagaucaaaagugggaggcaaucaaacugcaggcuuuauccuguuucaagacgaaagccaacuacccaaauugcuauaacaaguuuaagcauuucgucaaaaagaaacacgacgaagauuuuauuucucggcagcugaaugacacccguuacaucucgaaggaggcuaaaaacuaucuuagcaagauauguuccaauguguugguagcccccggucagaugacagcaacucucagacaucacuggggccugaacucaauucuaaaucuggaggaugacaccaaaacaagggaugaccaccgccaucacgccaucgaugcucucguuauggcgugcaguacucggucucaucugcaagaacuuagcaagagaaacagguacaauaagaacuaugacuugaaagauuucccggacccuuggcagaauuuucgacaggacgcagagaacgccguggcucaaauccuggucucccacaagaaaucaaagagcuuacucaccgugcgcacacacaaaaccauuaagaagggggucgaacauaaaaauaucggaguggccgcacggggccagcugcacaaggagucuguuuacggucuuagaaaagcccccaacuccaacaaggcuuuccauauuaggaaaccacuggaaaguuugacuacggagaagcagcucgagaagauaguggaugacagcauccgucugcuaauucugaaacgcaucaauauuaucgggggcuuuauaaagggaaaaaucccuaaggaaacauucuucguagucgaugagaacggcauuaaacagccccaaaucuuucucccaaaucggaacgggaaucccgugccuauuaagaagguuagaaucagggaaaacauaggaggugccgagaaacugaaggaaaauaccaaccaguacgugaauccacgaucuaaccaccaugucauuguguaugaggacuccaauggcgggcuuaaagaugacguagugacuuucuggaccgcaguugagcggaagcgccagggacaggaugucuuuaaauugccgaacgacggcgaaaagaucgugucaacacugcaaaucaaugauauguucuuacucggucugaacgacgaugacauuauaacccuuacaaguaaggagcugaaaaagcaccuauuuaaagugcagacucucagcucguccuucuacgaauuuagacugucuacggauagcacccagaauaagaacacuaauucaacagucuucaggcggauccagaguuuugggaugggcaaaaccggauggaaggcguucaaccccauuaaaguuaaguugaacuccaucggcgaggugaagauuaucuga

SEQ ID NO: 2820 - RNA, 3393 nt, Artificial Sequence
  Cas9 variant
augaccaacggcaagauccuggggcucgacauuggaauagccagcgugggugucggcaucauugaggcuaaaacagggaagguugugcacgcaaauuccagacuuuucucugccgcgaacgcugaaaauaacgccgagaggcggggauuucgcggcucacgacgucugaauagaaggaaaaagcaucggguaaaacgcgugagagauuuguucgaaaaguacgguaucgucacugacuuuaggaacuuaaaucugaaccccuaugagcuacgggugaaggggcucacggaacagcugaccaaugaggagcuuuucgcagcccugcgcacaauuaguaaacgaagaggaaucagcuacuuggaugacgcugaagaugacuccacuggcucuaccgauuaugcaaagucgauagacgagaacaggcggcuccugaaaacaaagaccccuggccaaauccagcuggaacgucucgagaaauacgggcaguuacgcggaaauuuuacuguuuaugaugagaacggugaagcccacagacugauuaauguguucucaacaagcgacuacgagaaggaagcuaggaagauccuugagacccaggccgauuauaacaaaaagauuacggcggaauuuaucgacgauuacgucgagauauugacucaaaaacggaaguacuaucauggcccagggaaugagaaaagucgaaccgacuacggacgcuucagaacagacggcacuacccuggaaaacauuuuugguauccuaauugggaagugcuccuucuauccggaugaguacagggcaucuaaagccagcuauacagcucaggaauacaacuuucucaaugaccugaacaaucuuaaggugcccaccgagacgggaaagcuguccacugaacagaaagaggccuugguagaguucgcaaagucaacagcuacccucggcccugccaaacuguuaaaggaaaucgcgaaaauccuggauuguaagguugacgagauuaagggcuaucgggaagaugacaaagggaagccagaucuccacacuuuugagcccuaccgcaaacuuaaguucaaccuggacagugugaauauagaugacuugagcagagaaguccuagauaaacuggccgacauccucacacugaacaccgagagggagggaauugaagacgcaaucaagcguaaucuuccuaaccaguucacggaggaacaaauaucugagauuaucaaugugcggaagucccagucaaccgcuuuuaacaaagguuggcauagcuucagugccaagcugaugaaugaguugaucccagaacucuacgcuacaucugaugagcagaugacuauucugacccgauuagaaaaauuuaaggugaaaaagaaguccagcaaaaacaucaagacaauugacgagaaagaaauaacugaugagaucuauaaucccgucguugccaagucggugagacagaccauuaaaaucaucaacgcagccguaaagaaauacggcgacuucgauaagauugugauagagaugccuagggacaagaaugcugaugacgaaaagaaguuuaucgauaaacgcaacaaggagaacaaaaaggaaaaggacgaugcgcugaaacgggcagccuaucuauacaaugggacagacaagcucccagaugaggucuuccacggaaacaaacaacuggaaaccaagauuagacuuugguaucagcagggcgagaggugcuuguacucugguaaaccgauccccauucaagagcuggugcacaauuccaacaauuuugaaaucgaccauauacucccucugucacuuaguuucgacgauagccuggcuaacaagguuuugguguauuccuggacuaaucaggagaaggggcagcgcacgccauaccaggucaucgacucuauggaugccgcauggagcuuucgagaaaugaaagacuacgugcucaagcaaaaaggccugggaaagaaaaagcgggauuauuuacugacaaccgagaacauugacaagaucgaaguuaaaaagaaauucauugagcguaaucuaguagauacuagauacgccucaagggugguccucaacagucugcaguccgcccuucgcgaguugggcaaggacaccaaagugagcgucgugcgggggcaguuuacaucucagcugagaaggaaguggaaaaucgauaagucacgagaaaccuaucaccaucacgcuguugacgcacucauaauugcggcuaguagccaacugaaguuaugggagaaacaggauaaucccauguucguggacuacggaaacaaucagguagucgauaagcagacuggugaaauccuguccgugucugacaacgaguauaaagagcuuguuuuucaaccuccauaccagggcuucgugaauacaauuucgagcaagggguucgaagacgagaucuuguuuuccuaucaggucgauucaaaauacaaccgcaaggugagugacgccacgauauacucuacccggaaggcaaaaaucggaaaggauaaaaaggaagagacuuauguacucggcaaaauuaaggacaucuacagccagaacgguuucgauacauuugugaagaaauauaauaaggacaaaacccaauuccugauguaccagaaggauccccuaacaugggaaaacguuauugaggucauccugggggacuauccgacuaccaaaaaguccgaggauggcaagaaugacgugaaauguaacccuuuugaagaguacagaagggaaaauggacucauaugcaaguauagcaaaaagggcaaagggacgcccauuaagucacugaaguacuacgauaaaaagcuaggaaacuguaucgacaucaccccagaggaaucucguaauaaagugauuuugcaguccaucaacccuuggcgcgccgacgucuauuucaaucccgagacacugaaguacgaguuaaugggucucaaauauagugaucugagcuuugaaaagggcacugggaacuaccacauuucucaagagaaauaugacgcuauaaaggaaaaggagggaaucggcaaaaaguccgaguucaaauuuacccuuuaccggaaugaucugauuuugaucaaggacauugccucaggugaacaggagaucuauagauuccucaguaggacaaugccaaacguuaaucauuacguggaacugaaacccuacgauaaggagaaguuugacaacgugcaggaacuuguagaggcacugggggaggcugauaaagucggccgaugcauaaagggacucaauaaaccuaacaucagcauuuauaaggugcggacugacguucugggcaacaaauacuucgugaagaaggaaggggauaaaccaaaacuugacuuuaaaaauaacaagaaauga

SEQ ID NO: 2821 - RNA, 3393 nt, Artificial Sequence
  Cas9 variant
augaccaacggcaagauccuggggcucgacauuggaauagccagcgugggugucggcaucauugaggcuaaaacagggaagguugugcacgcaaauuccagacuuuucucugccgcgaacgcugaaaauaacgccgagaggcggggauuucgcggcucacgacgucugaauagaaggaaaaagcaucggguaaaacgcgugagagauuuguucgaaaaguacgagaucgucacugacuuuaggaacuuaaaucugaaccccuaugaacuacgggugaagggucucacggagcagcugaccaaugaggaacuuuucgcagcccugcgcacaauuaguaaacgaagagggaucagcuacuuggaugacgcugaggaugacuccacuggaucuaccgauuaugcaaagucgauagacgaaaacaggcggcuccugaaaacaaagaccccuggccaaauccagcuggagcgucucgagaaauacggccaguuacgcgggaauuuuacuguuuaugaugaaaacggagaggcccacagacugauuaauguguucucaacaagcgacuacgaaaaggaggcuaggaagauccuugaaacccaggccgauuauaacaaaaagauuacggcggaguuuaucgacgauuacgucgagauauugacucaaaaacggaaguacuaucaugguccaggcaaugagaaaagucgaaccgacuacgggcgcuucagaacagacggaacuacccuggaaaacauuuuuggcauccuaauugguaagugcuccuucuauccggaugaauacagggcaucuaaagccagcuauacagcucaggaguacaacuuucucaaugaccugaacaaucuuaaggugcccaccgaaacggggaagcuguccacugagcagaaagaggccuugguagaguucgcaaagucaacagcuacccucggaccugccaaacuguuaaaggaaaucgcgaaaauccuggauuguaagguugacgaaauuaagggcuaucgggaggaugacaaaggcaagccagaucuccacacuuuugaacccuaccgcaaacuuaaguucaaccuggacagugugaauauagaugacuugagcagagagguccuagauaaacuggccgacauccucacacugaacaccgagagggaagggauugaggacgcaauccgucauaaucuuccuaaccaguucacggaaggacaaauaucugagauuaucaaggugcggaagucccagucaaccgcuuuuaauaaagguuggcacagcuucagugccaagcugaugaacgaguugaucccagaacucuacgcuacaucugaugagcagaugacuauucugacccgauuagaaaaauuuaaggugaauaaaaaguccagcaagaacacaaaaacuaucgacgagaaggaagucaccgaugagauuuauaaucccguuguggccaaaucgguaagacagacaauaaagaucauuaacgcagccgugaaaaaguacggcgacuucgauaaaaucgucaucgagaugccuagggacaagaaugcugaugacgaaaagaaauuuauugauaagcgcaacaaagagaacaagaaagaaaaggacgaugcgcugaagcgggcagccuaucuauacaaugggaccgacaaacucccagaugagguguuccacggaaacaagcaacuggaaacuaaaauaagacuuugguaucagcagggcgagaggugcuuguacucugguaagccgauccccauucaagagcugguucauaauuccaacaauuuugaaaucgaccacauucucccucugucacuuaguuucgacgauagccuggcuaacaaaguguuggucuaugccuggacgaaucaggagaaggggcagaagacaccauaccaggugaucgacuccauggaugcagccuggucuuuucgcgaaaugaaagacuacguacucaagcaaaaaggccugggaaagaaaaagcgagauuauuuacugaccacugagaacauagacaagaucgaaguuaaaaagaaauucauugagcggaaucuaguggauacccguuacgcuagcagagucgugcucaacucacugcagagugcccuuagggaguugggcaaggacacaaaaaucuccgucauucgcgggcaguuuaccagccagcugcggagaaaguggaaaaucgauaagucuagggaaacuuaucaucaccacgcaguggacgcgcucauaauugcugccucaagucaacugaaguuaugggagaaacaggauaaucccauguucguugacuacggaaacaaucaggugguagauaagcagacaggugaaauccugagcgucuccgacgacgaguauaaagagcuuguguuucaaccuccauaccagggcuucguuaacaugauuucuucgaagggguucgaagaugagaucuuguuuagcuaucagguggacuccaaauacaaucgaaaggucucagaugcaacgauauacaguacccgcaaggccaaaaucggaaaggacaaaaaggaagagacuuaugugcucggcaaaauuaaggauaucuacucucagaacgguuucgacacauuuauuaagaaauauaacaaggauaaaacccaauuccugauguaccagaaggacccccuaacaugggaaaauguaaucgaggugauacugcgggauuauccgacuaccaaaaagagcgaggacgggaagaacgauguuaaauguaauccuuuugaagaguacagaagggaaaacggccucgucugcaaguauuccaaaaagggaaaaggcacgcccauuaagucacugaaguacuacgacaaaaaguuggggaauuguaucgacaucaccccagagggaagcaaaaacgaaguggugcuucagucucugaauccuuggcgugcugaugucuauuucaaccccgagacauuaaaguacgagcuccugggucuuaaauauuccgaccugaguuuugaaaagggcacugggaaauaccauauuagccaagagaaguaugauguuaucaaggaaaaagagggaauuggcaagaaaucugaguucaaguuuaccuuguaccgcaaugaccucauacugaucaaagauacagccuccggugaacaggagauuuaucgguuccuaucaagaacuaugccaaacgugaagcacuacgcagaacugaagcccuacgacaaagagaaguuugauaaugugcaggaacucguagaggcucugggggaggccgacaaagucggaaggugcaucaagggccuuaacaaaaguaauuugagcauuuauaaggugcgaaccgauguucugggcaacaaguacuucgugaaaaaggaaggggacaaaccuaaguuagauuuuaaaaauaacaagaaguga

SEQ ID NO: 2822 - RNA, 3393 nt, Artificial Sequence
  Cas9 variant
augaccaacggcaagauccuggggcucgacauuggaauagccagcgugggugucggcaucauugaggcuaaaacagggaagguugugcacgcaaauuccagacuuuucucugccgcgaacgcugaaaauaacgccgagaggcggggauuucgcggcucacgacgucugaauagaaggaaaaagcaucggguaaaacgcgugagagauuuguucgaaaaguacgguaucgucacugacuuuaggaacuuaaaucugaaccccuaugagcuacgggugaaggggcucacggaacagcugaccaaugaggagcuuuucgcagcccugcgcacaauuaguaaacgaagaggaaucagcuacuuggaugacgcugaagaugacuccacuggcucuaccgauuaugcaaagucgauagacgagaacaggcggcuccugaaaacaaagaccccuggccaaauccagcuggaacgucucgagaaauacgggcaguuacgcggaaauuuuacuguuuaugaugagaacggugaagcccacagacugauuaauguguucucaacaagcgacuacgagaaggaagcuaggaagauccuugagacccaggccgauuauaacaaaaagauuacggcggaauuuaucgacgauuacgucgagauauugacucaaaaacggaaguacuaucauggcccagggaaugagaaaagucgaaccgacuacggacgcuucagaacagacggcacuacccuggaaaacauuuuugguauccuaauugggaagugcaacuucuauccggaugaguacagggcauccaaagccucuuauacagcucaggaauacaauuuucucaacgaccugaauaaccuuaaggugcccaccgagacgggaaagcugagcacugaacagaaagaguccuugguagaguucgccaagaauacagcaauccucggcccugcuaaacuguuaaaggaaaucgccaaaauucuggauuguaagguugacgagauaaagggcuaucgggaagaugacaaagggaagccagaucuccacaccuuugagcccuaccgcaaacuuaaguucaaccuggacucagugaauaucgauuacuugaguagagaaguccuagacaaacuggcggauauucucacucugaacacagagagggagggaaucgaagacgccauaaagcguaaucuuccuaaccaguucaccgaggaacaaauuagcgagaucaucaaugugcggaagucucaguccacggcauuuaacaaagguuggcauucauucagcgcuaagcugaugaaugaguugauuccagaacucuaugccaccagugacgagcagaugacaauccugacucgauuagaaaaauuuaaggugaaaaagaagucuuccaaaaacauuaagaccauagaugagaaagaaaucacagacgagauuuacaaucccgucguugcuaagagcgugagacagacuaucaaaaucauuaacgccgcaguaaagaaauauggcgauuucgacaagauagugaucgagaugccuagggauaagaacgccgacgaugaaaagaaguuuauuaauaaacgcaacaaggagaauaaaaaggaaaaggacgaugcucugaaacgggcggcauaccuauauaacgggaccgacaagcucccagaugaggucuuccacggaaauaaacaacuggaaacaaagaucagacuuugguaccagcagggcgagaggugcuuguauucggguaaaccgauucccauccaagagcuggugcacaacucuaauaacuuugaaauagaccauauccucccucugucccuuucauucgaugacagucuggccaauaagguuuugguguacagcuggaccaaccaggagaaggggcagaaaacuccauaccaggucauugacuccauggaugcugccuggucuuuucgcgaaaugaaggaguaugugcucaaacaaaagggccugggcaaaaagaagcgagacuacuuacugacgacagaaaauaucgauaaaauugagguaaagaaaaaguucaucgagcggaaccuaguugacacccguuaugcaagcagagugguccucaauucacugcagagugcccuuagggaauugggcaaagauacuaagguguccgucgugcgcgggcaguuuaccagccagcugcggagaaaauggaagauagacaagucuagggagacauaccaccaucacgcuguugaugcccucauuaucgcagcgucaagucaacugaaauuaugggaaaagcaggacaaccccauguucguggauuauggaaauaaccagguagucgacaaacagaccggugagauucugagcguguccgauaacgaguacaaggaacuuguuuuucaaccuccauaucagggcuucgugaauacuaucucuucgaaaggguucgaggacgaaauauuguuuagcuaccaggucgauuccaaguacaaccgaaaggugucagacgcuacaaucuauaguacgcgcaaagccaagauuggaaaagacaagaaagaggaaaccuacguacucggcaagaucaaggauauuuauucucagaaugguuucgacacuuuugugaaaaaguacaacaaagauaagacacaauuccugauguaucagaaagacccccuaaccugggagaauguuaucgaggucauacugggggauuacccgacaacuaaaaagagcgaagacggcaaaaacgaugugaaguguaauccuuuugaggaauaucggagagagaacggacucauuugcaaauacuccaagaaaggcaaggggacccccaucaagucacugaaauacuaugacaagaaacuuggaaauuguaucgauauuacgccagaagagagcaggaacaaggugaucuugcagucuauuaauccuuggcgugcagacgucuacuucaaccccgagacccugaaauaugaauuaaugggucucaaguacuccgaucugaguuuugagaaaggcacagggaauuaucacauaagccaagaaaaguacgacgccaucaaggagaaagaaggaauuggcaagaaaucugaguucaaguuuacucuuuaucgcaacgaccugaucuugauuaaagauaucgcuuccggugagcaggaaauauaccgguuccucucaagaaccaugccaaauguuaaccauuacguggagcugaagcccuaugacaaggaaaaauuugauaacgugcaggagcuaguagaggcccugggggaagcagacaaggucggaaggugcaucaaaagucucaauaagccuaacauuagcaucuacaaagugcgaacagauguucugggaaauaaguauuucgugaagaaagagggcgacaagccaaaacuugauuuuaagaacaauaaaaaguga

SEQ ID NO: 2823 - RNA, 3393 nt, Artificial Sequence
  Cas9 variant
augagcaacggcaagauccuggggcucgacauuggaguggccuccgucgguguuggcauaaucgaugcuaaaaccgggaaggugauucacgcaucuucaagacuuuucagugccgcgaaugcugagaacaaugccgaaaggcggggauuucgcggcgcacgacgucugacaagaaggaaaaagcaucggaucaaacgcguaagagacuuguucgagaaguacgaaauugugacugauuuuagcaacuuaaaucugaaccccuaugagcuaagggucaagggucucacggaacagcugaccaaugaggagcuuuucgccgcucugcggacaaucgcaaaacgccgagggauauccuacuuggacgaugccgaagacgauucuacuggaucgucagacuaugcuaagagcaucgaggaaaacagaaggcuccugaaaaauaugaccccuggccaaauucagcuggagcggcucgagaaguacggccaguuacgugggaacuuuacaguguaugaugaaaauggagaggcccaccgccugaucaacguuuucaguaccuccgacuacaaaaaugaagcgagaaagauucuugagacucagucuaacuauaauaagcaaaucacagaugaauuuauagaggacuacauugagaucuugacccagaaaaggaaguacuaucaugguccaggcaacgaaaagagccggacggauuacgggcgauaucgcacugacggaaccacacuggagaacauuuucggcauccuaaucgguaagugcacuuuuuacccggacgaauauagaaccuccaaagcaucauacacagcccaggaguauaauuuccucaacgaucugaauaaccuuaaggugcccaccgaaacggggaaacugaguacugagcagaagcacuacuuggucgacuuugcuaagagcucuaaagcccucggaguggcaaagcuguuaaaagagauugcuaagauaguagaauguuccguugaugacaucaaaggcuacagggaggauaauaagggcaagccugaccugcauacauucgaaccauaucggaaacucaaguuuaaccuuucacugauugauaucgacgaguugagccgcgaaacccuagauaaacuggccgacauacucacucugaauacagagagagaggggauugaagaugcgaucaagaggaaccuucccaaucaauucaccgaggaacagaucguggagcuggucaacgugcguaaaaaucagaguucugccuucaacaagggauggcacuccuuuagcgugaaguugaugaaugagcucauuccugaacuguacgcaucgucugaggaacagaugacgaucuuaacccggcuggagaaauucaaggucaacaaaaaguccucagaaaauacaaaaacuauuaacgagaaggagauaaccgacgaaaucuauaacccaguuguggcuaagaguguaagccaaacagugaaaauuaucaaugccgcugucaagaaauacggugacuuugauaagaucgugauugagaugccccgagacaaaaacgccgaugacgaaaagaaauucauagauaagaagcagaaagagaaugcaaaggaaguugaggacgcccuaaaaagagcugcguaucucuacaacggcacugauaagcugccugacgggguguuucacggaaauaaacagcuuaagaccaagaucagguugugguaucaacagggcgagcgcugccuguacuccgguaaaccaauuucuauccaggaucucguccauaacagcaauaacuucgaaauugaccacauccugccgcuuucacugaguuuugaugacuccuuggcaaauaaggugcucguauacgccuggacaaaccaggagaaagggcaaaagacccccuaucagguuauagauagcauggacgcugccuggucuuuccgggaaaugaaagacuacgugcugaaucagaagggcaucggaaagaaaaagagagaguauuuacugacuacggaaaacauugauaaaaucgaggucaagaaaaaguuuauugagaggaaucuaguggacacacgcuacgcaucacgagucgugcucaacaguauccaggccgcucugaaggaacuugauaaagacaccaagguuagcgugauacggggccaauucacuucccaguugcguagaaaauggaagauugauaaaucuagggagaccuaucaucaccacgccguagacgcacugaucauugcggcuucgagccagcucaagcuguggcagaaacaagaaaauccuauguuugucgauuacggggagaaccaggugguuaacaaggagacaggagaaaucuuauccgugucagacgaugacuauaaggagcuggucuuccagccacccuaccaggguuuugugaauaccauaaguucuaaagccuucgaagaugagauccuuuucagcuaccaaguagacuccaaguauaaccgcaaagugucagaugcaacuauuuacagcacacggaaggccaaauugggcaaggacaagaaagaagagacguauguucucgggaagaucaaagacauuuacucucaggauggauuugacgcuuucaucaagagauauaaaaaggauaagacccaguuucugauguaccaaaaagacccugucacuugggagaaugugauagaagugauucuaagggauuauccauccgagaagcugagugaagacggcaaaaagaacgucaaauguaaucccuucgaggaauaccgacgcgagaacggucucaucugcaaguacagcaagaaagggaagggcacaccgaucaaaucucugaaguauuacgauaaaaaguugggaaauuguauugacaucaccccuaagggcuccaaaaacgagguugugcuucagucacugaaucccuggcgggccgauuuauauuuuaacccagacacacucaaguacgaacugauggggcuuaaauauagugaucugagcuucgagaagggaacugguaaauaccauauuucgcaggaaagauaugacgagauaaaggugaaagaaggcaucgggaaaaauuccgaguuuaaguucaccuuguacaggaacgaccucauucugaucaaagauacggagucuggagaagaggaacuauaccguuuucugagccgcaccaugccuaauguaaagcacuaugucgagcucaaacccuacgacaaggagcgguaugauggcggucaggaacugaugaaaguguucgggaacguugcaaauggcggacaaugccuuaagucauugaacaagaguaaccuguccauuuacaaagugagaacagacgucuuaggcaauaaguuuuucaucaaaaaggagggggauaaaccaaagcucgacuuuaagaacaauaaaaaguga

SEQ ID NO: 2824 - RNA, 3393 nt, Artificial Sequence
  Cas9 variant
augaccaacggcaagauccuggggcucgacauuggaauagccagcgugggugucggcaucauugaggcuaaaacagggaagguugugcacgcaaauuccagacuuuucucugccgcgaacgcugaaaauaacgccgagaggcggggauuucgcggcucacgacgucugaauagaaggaaaaagcaucggguaaaacgcgugagagauuuguucgaaaaguacgguaucgucacugacuuuaggaacuuaaaucugaaccccuaugagcuacgggugaaggggcucacggaacagcugaaaaaugaggagcuuuucgcagcccugcgcaccauuaguaagcgaagaggaaucagcuacuuggaugacgcugaagaugacuccacaggcucuacugauuaugcaaaaucgauagacgagaacaggcggcuccugaagaauaaaaccccuggccaaauccagcuggaacgucucgagaaguacgggcaguuacgcggaaacuuuacaguuuaugaugagaauggugaagcccacagacugauuaacguguucucaaccagcgacuacgagaaggaagcuaggaaaauccuugagacucaggccgauuauaauaagaaaauuacagcggaauuuaucgacgauuacgucgagauauugacccaaaagcggaaauacuaucauggcccagggaacgagaagagucgaacggacuacggacgcuucagaacugacggcaccacacuggaaaacauuuuugguauccuaauugggaaaugcaauuucuauccggaugaguacagggcauccaaggccucuuauacugcucaggaauacaacuuucucaaugaccugaacaaucuuaaggugagcaccgagacaggaaaacuguccaccgaacagaaggagucauugguagaguucgccaaaaacacggcaacucucggccccgcuaagcuguuaaaagaaaucgccaagauccuggauuguaagguugacgagauuaaaggcuaucgggaagaugacaaggggaaaccugaucuccacacauuugagccauaccgcaaacuuaaauucaaucuggaaaguauaaacaucgacgauuugagcagagaggugauugacaagcuagcggauauccugacccucaauacugagagggaaggaauagaggacgccauuaagcguaaccugcccaaucaguucacagaggaacaaaucucugagaucauuaaaguccggaagucccagucaaccgcauuuaacaaagguuggcauagcuucagugcuaaacuuaugaaugaacugaucccugaguuguacgccacgucugacgaacagaugaccauucucacacgacuggagaaauuuaaggugaacaagaaauccagcaagaauacuaaaaccauagaugaaaaggaggugacagacgagaucuauaacccagucguugcuaaaucggugagacagacuauuaagaucaucaacgccgcaguaaagaaguacggcgauuucgacaagauugugauagaaaugcccagggauaaaaaugccgacgaugagaagaaauuuaucgacaagcgcaacaaagaaaauaagaaggagaaagaugacgcuuuaaagcgggcggcauaucuguacaacucuuccgauaaacuaccugacgaagucuuccacgggaauaagcaacucgagaccaaaauuagacugugguaucagcagggagagaggugccuuuacucaggcaagccaaucaguauucaagaauuggugcacaacagcaauaacuuugagaucgaucauauacugccgcucucccugucuuucgacgacagccuugccaauaagguucugguguaugcuuggacaaaccaggaaaaaggucagaagacccccuaccaggucaucgauucaauggacgccgcauggaguuuucgcgagaugaaagauuacguguugaagcaaaaagggcucggcaagaagaaacgagacuaucuguuaacuacggaaaauauugauaagaucgagguaaagaagaaauucauugagcggaaccugguugacacacguuacgccuccagagugguccuaaauagccuccagucugcucugagggaacuuggaaaggauaccaaagugucagucgugcgcggccaguuuacaagucaguugcggagaaaguggaagaucgacaaaagcagggagaccuaucaccaucacgccguugaugcacugauaauugcggcuuccucucaacucaagcugugggaaaaacaggacaacccuauguucguggauuacgggaagaaucagguagucgacaaacagacaggagagaucuuaucggugagcgaugacgaguauaaggaacugguuuuucaaccacccuaccaggguuucgugaacaccauuuccucaaagggcuucgaggacgaaauccuuuuuaguuaucaggucgauucuaaauacaaccgaaaggugagcgacgccacuauauacuccacacgcaaagcaaagaucgggaaagauaagaaggaggaaacguauguauugggaaaaauuaaggacaucuacucacagaauggcuucgauaccuuuauuaaaaaguauaacaaagacaagacucaauuccucauguaccagaaggauagccugacaugggagaaugugaucgagguuauacuacgggacuauccuaccacuaaaaagucugaagaugguaaaaacgacgucaaguguaauccauuugaggaauacagaagggagaacgggcugauuugcaaauauuccaagaagggcaaaggaacucccaucaagagucucaaauacuacgauaagaaacugggcaauuguaucgacauuaccccggaagagagccguaacaaggugauccuucagucuauuaauccuuggcgcgccgacguguauuucaaccccgagacguugaaauacgaacugaugggguuaaaguauuccgaucucucauuugagaagggaaccgguaauuaccacauaagucaagaaaaauaugacgcuaucaaggagaaagaaggcauugggaagaaaagcgaguucaaguuuacacuguaccggaacgaucuuauccugauuaaggacaucgccucgggagagcaggaaauauauagauucuuguccaggacuaugccaaaugucaaccauuacguugagcucaaaccuuacgauaaggaaaaauuugacaaugugcaggagcugguggaggcacuaggcgaagcugauaagguaggucgaugcaucaaagggcugaacaagcccaacauuucuaucuauaagguccggaccgacgugcucggcaauaaauacuucguuaagaaaaagggagauaaaccaaagcuggacuuuaagaacaauaaaaaguga

SEQ ID NO: 2825 - RNA, 3393 nt, Artificial Sequence
  Cas9 variant
augaccaacggcaagauccuggggcucgacauuggaauagccagcgugggugucggcaucauugaggcuaaaacagggaagguugugcacgcaaauuccagacuuuucucugccgcgaacgcugaaaauaacgccgagaggcggggauuucgcggcucacgacgucugaauagaaggaaaaagcaucggguaaaacgcgugagagauuuguucgaaaaguacgguaucgucacugacuuuaggaacuuaaaucugaaccccuaugagcuacgggugaaggggcucacggaacagcugaccaaugaggagcuuuucgcagcccugcgcacaauuaguaaacgaagaggaaucagcuacuuggaugacgcugaagaugacuccacuggcucuaccgauuaugcaaagucgauagacgagaacaggcggcuccugaaaacaaagaccccuggccaaauccagcuggaacgucucgagaaauacgggcaguuacgcggaaauuuuacuguuuaugaugagaacggugaagcccacagacugauuaauguguucucaacaagcgacuacgagaaggaagcuaggaagauccuugagacccaggccgauuauaacaaaaagauuacggcggaauuuaucgacgauuacgucgagauauugacucaaaaacggaaguacuaucauggcccagggaaugagaaaagucgaaccgacuacggacgcuucagaacagacggcacuacccuggaaaacauuuuugguauccuaauugggaagugcuccuucuauccggaugaguacagggcaucuaaagccagcuauacagcucaggaauacaacuuucucaaugaccugaacaaucuuaaggugcccaccgagacgggaaagcuguccacugaacagaaagaggccuugguagaguucgcaaagucaacagcuacccucggcccugccaaacuguuaaaggaaaucgcgaaaauccuggauuguaagguugacgagauuaagggcuaucgggaagaugacaaagggaagccagaucuccacacuuuugagcccuaccgcaaacuuaaguucaaccuggacagugugaauauagauuacuugagcagagaaguccuagacaaacuggccggaauccucacacugaacaccgagagggaggguauugaagaugcaaucaagcguaaucuuccuaaccaguucacggaggaacaaauaucugagauuaucaaugugcggaagucccagucaaccgcuuuuaacaaaggcuggcauagcuucagugccaagcugaugaaugaguugaucccagaacucuaugcuacaucugacgagcagaugacuauucugacccgauuagaaaaauuuaaggugaaaaagaaguccagcaaaaacaucaagacaauugacgagaaagaaauaacugaugagaucuacaaucccgucguugccaagucggugagacagaccauuaaaaucaucaacgcagccguaaagaaauauggggacuucgauaagauugugauagagaugccuagggacaagaaugcugaugacgagaaaaaguuuaucaacaaacgcaacaaggaaaauaaaaaggaaaaggaugacgcgcugaaacgggcagccuaccuauauaacggaacagauaagcucccagacgaggucuuccacggcaauaaacaacuggaaaccaagauuagacuuugguaccagcagggugagaggugcuuguauucugggaaaccgauccccauucaagagcuggugcacaacuccaauaacuuugaaaucgaucauauacucccucugucacuuaguuucgacgauagccuggcuaauaagguuuugguguacuccuggacuaaccaggagaagggccagaaaacgccauaccaggucaucgacucuauggacgccgcauggagcuuucgcgaaaugaaggaguaugugcucaaacaaaagggacugggcaaaaagaagcgagauuacuuacugacaaccgaaaauauugacaaaaucgagguaaagaaaaaguucauugagcggaaccuaguugauacucguuaugccucaagagugguccucaauagucugcaguccgcucuuagggaauuggggaaagacaccaaggugagcgucgugcgcggacaguuuacaucucagcugcggagaaaauggaagaucgauaagucaagggagaccuaccaccaucacgccguugacgcacucauaauugcggcuaguagccaacugaaauuaugggaaaagcaggauaaccccauguucguggacuaugguaauaaccagguagucgauaaacagacuggcgagauccuguccgugucugacaaugaguacaaggaacuuguuuuucaaccuccauaucagggguucgugaacacaauuucgagcaaaggauucgaggaugaaaucuuguuuuccuaccaggucgacucaaaguacaaccgaaaggugagugaugccacgauauauucuacccgcaaagcaaagaucggcaaagacaagaaagaggaaacuuacguacucgguaagauuaaggacaucuauagccagaauggguucgauacauuugugaaaaaguacaacaaagacaagacccaauuccugauguaucagaaagauccccuaacaugggagaauguuauugaggucauccugggcgacuacccgacuaccaagaaguccgaagauggcaaaaacgacgugaaguguaauccuuuugaggaauaucggagagagaacggacucauaugcaaauacucaaagaaagggaagggaacgcccauuaagagccugaaauacuaugauaagaaacuugguaauuguaucgacaucaccccagaagagucuaggaacaaggugauuuugcaguccaucaauccuuggcgugccgaugucuacuucaaccccgagacacugaaauaugaauuaaugggccucaaguacagugaccugagcuuugagaaagggacuggaaauuaucacauuucucaagaaaaguacgaugcuauaaaggagaaagaaggcaucgguaagaaauccgaguucaaguuuacccuuuaucgcaacgaccugauuuugaucaaagacauugccucaggggagcaggaaaucuaccgguuccucaguagaacaaugccaaauguuaaccauuacguggagcugaagcccuaugauaaggaaaaauuugacaaugugcaggagcuaguagaggcacugggcgaagcugauaaggucggaaggugcauaaaaggccucaacaagccuaacaucagcauuuacaaagugcgaacugacguucuggggaauaaguauuucgugaagaaagagggagauaagccaaaacuugacuuuaagaacaauaaaaaguga

SEQ ID NO: 2826 - RNA, 3396 nt, Artificial Sequence
  Cas9 variant
auggcccagcacguguucggccuggacaucgggauugcuagcgucggaugggcaauacucggugagcaaagaaucauugaucuuggcguuaggugcuuugacaaggccgaaaccgcgaaagagggggauccccugaacuugacacggcgccaggcucgauuacugcguagaaggcuauaccggcgcgccuggagacucacucagcuguccaggcuucugaagcggaaaggauugaucgcagacgccaaacucuucgcuaaggcaccuucuuauggcgauucagccugggaacugcgccgacagggucuggacagacucuuaacgccacuggagugggcuagggugauuuaccaucaauguaagcaccggggguuucauuggaccaguaaggccgaagaggcgaaagcagauagcgacgccgagggaggccguguaaagcagggccuugcucacacaaaagccuugaugcaggcaaagaauuaucgcuccgcugccgaaauggugcuggcggaguucccggaugcccagagaaacaaaagggggcaauacgacaaggcacuaucucggguccuccugggagaagaacuugcucuguuguuugccacucagcgacgccucgguaauccccaugcuucggauuucuuugagaagcugaucuuaggcgacggggauagaaaaucaggacuguucuggcagcagaagccugcccucagcggcgcagaccuucugaaaauguuggguaagugcaccuuugaaaaaggggaguauagggccccaaaggcuaguuucuccguggaacggcacguuuggcuaacacgccugaacaaucucagaauaguggucgacggaaggucucguccccugaacgaggcggaacggcaagcagcccuucuguugccuuaccagaccgagacuagcaaauauaagacacucaagaaugcuuuuaucaaagccggccuguggggcgauggggugcgauucggagguuuagcauacccaucccaggcccaaauugacgcugagaagaccaaagaucccgaagaccaguuucugguaaagcuaccugccuggcacgagcucagaaaagcauucaaggcggcuggccaugaagcccuguggcagcagaucucaacgccagcacuugauggggacccgacuuugcuggaucaaauugccaccguucucaguguguacaaggacggagcugaggucgugcagcagcugaggcagcuugcccugcccgaaccugcagcuagcaucgccguguuggagaaaauaucuuucgauaaguuuuccucacucagccugaaagcguuacgccggauugucccacugaugcaaaguggccuaagauaugacgaggccguugcucagauccccgaauacggucaccauucucagaggauugagccuggggcagccaagcaccucuaucugccacccuucuacgaagcucagcgcaaauaugccggcaagggagaucacaucggcuccaugcaauuucgagacgacgcagauaucccgcggaacccugugguacuucgugcguugaaucaggccagaaagguggucaacgcucugauuagggaguacgggagccccauagccgugaauaucgaaauggcacgcgaccucucgcggccacuggaugagagaaacaaaguuaagagggcucaggaggaguuccgagaccgcaaugaucgggccagaucugaguuugaaagggacuucggauauaaaccuaaggcagccgcuuuugagaaauggauguuauaccgugagcagcugggucaaugugcguacucccagcagccccuugauauucaacgcguguuggacgaucauaacuaugcccaggucgaccacgcacucccauacucacggaguuaugaugacagcaagaauaacaaggugcugguacuaacacaugaaaaccagaauaaaggcaacagaacugcuuucgaguaccugaccuccuuucccgauggggaagacggagagagguggcgaacauucguugccugggugcagggcaauaaggccuaucggauggcuaaacgcaacagacuccugaggaagaauuacggugucgacgaaucuaaaggguuuaucgaucggaaccuuaaugacacccgauauauaugcaaguucuuuaaaaacuacguggaggagcacuugcaacuggcagccagagcggauggcgacacggcuaggcgcugugucgugguuaauggacaguuaacugccuuccuccgugcacgguggggccugacaaaggugagaggggauagcgacaggcaucacgcccuugaugcugcaguagucgccgcgugcacccacggaauggugaaggcucuggccgacuacucacgccgaaaagaaauuaguuucuugcaggaggguuuuccugauccagaaacuggcgagauccucaacccggcagccuucgacagagcucggcagcauuuucccgaaccuuggacacacuucgcccaugagcugaaggcaaggcuauuuaccgaugaccuggcugcccuccgcgaggauaugcaacgucugggguccuauacgaccgaagaccuuggaagauugcggacacuguucguuagcagggcgccacagcgccgaucuggcggugccgugcacaaagagacuaucuacgcacagcccgaaucauuaaagcagcaagggggcgucauugagaaaauccuccugaccagucuuaagcugcaggacuuugauaagcuacucaauccugaaagcaacgaccacuucguggagccacauagaaaugagcggcuguaugcugccauuaggcagcgcuuggaacaauuuggaggcagagcugauaaagcauucgggcccgacaaccuguuucacaagccggauaaaaauaaccagccuacaggaccaguagugagguccauaaaguuaguucggggcaaacagacugguauccccauucgugggggacucgccaagaacgacucuaugcugcgcgucgauaucuucaccaaggccggcaaauuucaucuugugccuguguacguccaccaucgaguuacaggucugcccaauagagcuaucguggcguucaaggacgaggaugaauggaccuugauugacgagucguucgcauuucucuucagcguguauccaaacgauuacguaaaagucacucugaagaaagagcagcaauccggcuauuacucaggggccgacaggaguacgggagcuaugaaucuaugggcccacgaccgggcagccucugugggcaaggaugggcugauacgcggaaucggcguuaagacagcucuuagcguggaaaaauuuaacgucgacgugcucgguagaauuuaccuggcgccucccgagaccagguccggguuggccuga

SEQ ID NO: 2827 - RNA, 3399 nt, Artificial Sequence
  Cas9 variant
auggcccaguacguguucggccuggacaucgggauugcuagcgucggaugggcaguucucgaugcccaaagaauaguggaccuugguguaaggugcuuugauaaggcggagaccgcuaaagaaggcgacccccugaacuugacacggcgccaggcccgauuacugcguagaaggcuauaucggcgcgcauggagacucacucagcuggccaggcuuuucaagcgggaggggcugaucgaugacgcuaaauuguuugcaaaggccccuuccuggacggaaaaugcuugggagcuccgccugcgaggacuggaucaccucuuaaccccacuggaaugggccagagugauuuaccaucuuuguaaacacaggggcuuccauuggacaucuaaggcggaggaggcaaaggccgaaucagacgcugagggugggcgggucaaacagggauuggcccacacuaaggcacugaugcaagugaaaaacuaucguaguaccgcugaaaugguucuagccgaguuuccgggcgcgcagcgcaauaagagaggccaguacgauaaagcccucagcagggugcugcuuggggaggaacuggcacuccucuucgcuacacagcggcgacugggaaacccccaugccuccgagcacuuugaacaauuaauccugggucacggcgaccgcaagucuggguuguucuggcagcagaagccugcucuuucgggagccgaucuguugaaaaugcuaggcaagugcaccuuugagaaaacugaauauagagcaccaaaggccucauucagcgcugagaggcaugucuggcugacacggcucaauaaccugcgcauugugguagacgguagagcgaggccccuuaaugaugcagagcgucaggccgcucuguugcucccuuaccaaaccgaaacguuuaaauauaagacucugaaagccgcauucguuaaggugggguuauggggagacggcguccgguuuggcgggcuggccuacccaagucaggcucaggccgaggcagaaaaggcgaaagaccccgaggaucaauuccuagugaagcucccugcuuggcacgaacugcgaaaagccuucaaggcagccggacaugaggcucuuuggcagcagaucuccaugccagccuuggaggaagacccgacccugcucgaucagauagcaacagugcugucugucuacaaagacgguacugagguugugcaacagcuuagacagcuggcuuugcccgaaccugaugccagcaucgcgguacucgagaagauuagguuugacaaguucuccucacugaguuuaaaagcccugcgccggaucgugccacuaaugcagggcgggcucagauaugaugaagcugucgcacaaauucccgaguacggacaccacagccagaggaucgacccuggcgccacccgccaucuguaucuuccacccuuuuacgaggcucagcgaaaguaugccgguaaaggggaucggauaggcucuaugcaguuccgugaagacgcagaugugccgagaaacccuguuguguugagggcgcugaaucaagcccgcaaggucgugaacgcucucauucgggaguacggaucccccguagccguuaauaucgaaauggcaagagaccugucaaggccauuagacgagcgaaacaaagugaagcgcgcucaggaggaauuucgggauagaaaugacaaggccaggagcgaguucgaacgugauuuuggcuauaaaccuaagggggcagucuucgagaaauggaugcuguaccgcgaacagcuuggacagugugccuacagucaacagcccuuggacauucagcgggugcucgaugacccaaacuaugcucaagucgaucacgcgcugcccuacucuagauccuaugacgauagcaagaauaacaaagugcuaguucugacaagggagaaccagaauaaggguaaccgaaccccuuuugaguaccucacgucguucccaggcggggaagacggagagcgguggcgcgccuuuguggcauggguacagggcaauaaggcuuauagaauggccaaaaggaaccggcugcuucgaaagaauuacgguacugaugaaucuagaggguucaucgaccgcaacuugaaugauacaagguauaucugcaaauuuuucaagaacuacgucgaggaacaucugcaguuagccgcucguaccgacggcgacacugcacggagaugugugguugugaauggacaacucacagccuuccugagggcgcgcuggggccuugcuaaaguccgaggggauuccgacagacaccaugcccuggaugcagccgugguagcugcaugcacccacggaauggugaaggccuuggcggacuacucacggaggaaagagauugcuuuucuccaggaggguuucccggaucccgaaacgggcgagauacugaaccuagccgcauuugaccgcgcccgugaacacuucccugagccauggccccauuuugcucacgaacugaaggccagacucuucaucgaugaccugguugcacuucgggaggauaugcagcauuuggggaguuaugcucaggacgaucuggacagguuacgcacccucuuugucagccgagccccucaaagacggaauggaggcgcggugcacaaggguacaauuuacgcccagccagagaaccugaaacagcagggguccacuaucgaaaagauacuucugaccggccuaaaacuccaagauuucgacaagcuguugaaucccgagucuagcgaccacuuuguggaaccgcauaggaacgagcgccuguaugcagcuauuagaaggcgguuagaggaguucggaggcaaagccgauaaggcuuuugggccugacaagccauucuacaaacccgauaagaauggacagccuacaggccccaucguccguucaaucaaacucguucgcgguaagcagacugggauuccaauccgaggaggccuggccaaaaacgacaguaugcuuagaguggauguguuuaccaaggcagguaaguuccaccugguaccugucuaugugcaucacaggguuacaggcuugcccgaccgggccauuguggcuuucaaagaugaagaagaguggacccucauagacgaauccuacgcguuucuguucagcgucuauccaaacgauuuuguguguguucaacagcgcgggaagccgcuaaucgagggauacuacgcaggccuggacagagccaaugggaacauuaaugugugggcucaugauagggccgcaucuguaggaaaagacggccuuauccgggguaucggggucaagacugcccucucacuggagaaauugaacguggacgugcugggacgaauuuauccugcucccccagaaacgagacgcggcuuagcguga

SEQ ID NO: 2828 - RNA, 3399 nt, Artificial Sequence
  Cas9 variant
augaagaaaauccugggcguggaccucgggauuaccagcuucggauacgccauacuucaggagacagguaaggaucuguauagaugcuuggacaacuccgucguuaugaggaauaaccccuacgaugaaaaaucuggcgagucaagucaaagcauccgguccacucagaagucuaugcgccgauuaauugaaaaacguaagaagagaaucagguguguggcucagacgauggagcgguaugggauucuggacuacucggaaaccaugaaaaucaaugauccuaagaacaauccaauuaaaaaccgcuggcagcuaagagcaguagacgccuggaagaggccgcucucaccccaagagcuguuugcgaucuucgcucacauggccaaacaucggggauauaagagcauugcaacagaggaucuuaucuacgaacuggaguuggaacucggccugaaugacccugagaaggagagugaaaagaaggccgaugagcgccgacagguguauaacgcucugagacaccucgaagaguuaaggaaaaaguacgguggggaaacuauugcacagaccauccaucgggccgucgaggcuggagaccugcguuccuaccgcaaucacgaugacuaugagaaaaugauaagaagggaagauauugaggaagagaucgaaaaggugcuuuugcggcaggccgagcugggcgcgcuaggccucccagaggaacaaguuucugagcugauugacgaacuuaaagcaugcaucacagaccaggagaugcccaccaucgaugaaagccuguuugggaaguguacuuucuacaaggacgaguuggccgcuccugccuauuccuaccucuaugaucuguaccgauuauauaaaaagcuggcagaccucaacauugauggauacgaggugacacaggaagaccgcgagaaagucauagaauggguggagaagaaaaucgcucaggguaagaaucuuaagaaaauuacccauaaggaucugagaaaaaucuugggccuagccccagagcaaaagauauuugggguagaagacgagaggauuguuaaaggaaagaaggaaccccggacguucgugccauuuuucuuucuggcggauaucgccaaauucaaggagcucuuugcaucaauccagaaacacccugacgcucugcagauuuuccgcgaacuugccgagauccugcaaagaaguaagacuccgcaggaggcuuuggauaggcuccgugcccugauggcaggcaaagguauugacaccgacgaucgggaauuacuggagcuauuuaagaacaagcgaagcgggacaagagaacucucucacagguacauacuggaggcccuucccuuguuccuggaaggauaugacgagaaagagguccagcgcauccucggcuucgaugaccgggaagauuacuccagauauccuaagucacugaggcaucuucaucugcgcgagggcaauuuguuugaaaaagaggaaaacccaauuaauaaccacgcugugaaaagccucgcgaguugggcacugggguuaaucgccgaccugucuuggcgauacggacccuucgaugagaucauucuagagacuacccgggacgcucucccugagaaaauacguaaggaaaucgauaaagccaugagagaaagggagaaggcacuggacaagauuaucgguaaauauaagaaagaguuuccauccauugauaagcgccuugcccggaaaauccaguugugggaaagacaaaagggccuggaccucuacagcgggaaggugauaaaccugucgcaguuacuggauggaucugcugacaucgagcacauugucccccagucccuuggcgguuugucaacagacuauaauaccaucguuacgcucaaaagugugaacgccgcaaaggggaauaggcugccgggcgauuggcuagcgggaaacccugacuaccgagaacgcauuggcaugcugagcgagaaagggcucaucgauuggaagaaacggaagaaucugcuugcucaguccuuggacgaaauauacacugagaacacacacucuaagggaauuagagccaccagcuaucuggaggcauuaguagcccaagugcucaaaagguacuaucccuucccagauccugaacugcguaagaaugguaucggcguccgcaugauucccgggaaagugacuucaaagacacggagucuucugggaaucaaauccaagagcagagagaccaacuuucaucacgcugaagacgccuugauacucucuacgcugaccaggggcuggcagaaucgacuacaucggaugcugcgcgauaacuacgguaagucagaggcagaacucaaagagcuguggaagaaauauaugccacacaucgaggggcuuacauuggcugacuacauugaugaagccuucagaagguuuaugaguaagggcgaggaaagccuguucuaucgggacauguuugauacuauccgauccauuucuuacuggguugacaaaaagcccuuaucggcgagcucccauaaagagaccguguacucaaguagacacgaagucccuacacuccgcaagaauauccuggaggccuucgauucucuuaacgugauaaaggacaggcacaaacugacuaccgaggaauuuaugaagcguuaugacaaagagauucggcagaagcuauggcuccauagaaucggaaauacaaacgaugaaagcuacagggcuguagaggagcgcgcaacccagaucgcccaaauucugacucgauaucaguugauggacgcucagaaugauaaagaaaucgacgagaaguuccagcaagcccugaaggaauuaauuacguccccaauagagguuacaggcaaacuccugagaaagaugcgguuuguguacgauaaacuuaacgcaaugcagaucgacagggggcuggucgaaaccgauaagaacauguugggaauacacaucucaaaagguccgaaugagaagcucauuuuccgccguauggacgugaacaaugcgcaugagcugcagaaggaaagaagcggcauccuaugcuaucugaacgagaugcuuuucauauuuaauaaaaaggggcucauccacuacggaugucugcggucuuauuuggaaaaaggccaagguuccaaguacauugcccuguucaaccccagguuuccugcuaauccaaaagcccagcccaguaaguucacuagcgauucuaagaucaaacaggucgggauuggcuccgcaaccggaaucauaaaggcucacuuagaccucgauggccaugugcgcucauacgagguuuuugggacacugccugaaggaaguauugagugguucaaagaggaaagcggcuauggucgaguggaggacgacccacaccauuga

SEQ ID NO: 2829 - RNA, 3402 nt, Artificial Sequence
  Cas9 variant
auggaccugaacuacagaaucggccucgauauugggauagccagcgugggaugggcuguccuugagaauaacuccaaggacgaacccguuaggaucguggaucuggguguacgguuguucgaggcagccgaagugccuaaaaccggcgcggcuuuagccgagccacgccgagaagcacguacaacuagaaggcggcugcgcagaaggaagcaccggcuagagcgcaugaaauggcuccugcaggaguaugggcuuauucaaacggaagaguuuaugaagcgauaccauucugccggacugccggacgucuauagauugagguacgaaggccucgagcggaaacugaaggaugaggaacuggcucagauccucauucacaucgguaagcaucguggguuccgcucaaccagaaaagcagaguuaaaggacaaaaaugauaaggaaacaggagccgugcugagugcuacuagggagaacgaaaaacuuauggaggagcacggcuaucggaccgccggcgaaaugauauacaaggacgauaaguuucgaacagggugcaccuggaaagaggaaggauaucgcuugacucccagaaauaaggagggugacuacaaaaacacaaugcugagggcgcuacucgaagaugagguuaaggugaucuucgacugucagcggaaauuuggcaaucagaaggcaagcgaggaacuggagaaagccuaccuugcuauuaugaccucccaacgcucuuucgauauggggccuggaaagcagccagacggcucggccucacccuaugcaauggaagguuuuggggacagagucggacugugcgcuuuggagccuagggaaaagcaggagccacgugcccccaaagcggccuacacgagcgaacucuucguggcacugcagaagaucaaccauuuacggauuacugaaaagaauggcaagggccgagggcugaccagugaggaaagagagaggcucuccgaucuucugcacaaaaagaaggaguugacauauggagcuguacgcaaagaacuacaacuggaccuccgguacagauuuaacacucugaauuauucuagcaagaaaaugaccgaggaagagaagaucaaagaugccgaaaaggcuaaguucguuuccauggugucacacuacgaguauaggaaacgcaugagugguaugcuugagcagcugagcccugaggagcaggccgacuugauggaugaagucggcaagauacucacacuguacaaaaacgacgauacccgaucucgggaguuucagaaguuagggcuggacuccgaaauuacggaggagcuacucgaacugaauccacguggauuccaacaugugucacuuaaagcaaugaagaaguugaugccguaccugaaagagggccucacuuaugauaaggccugugcugaagcggguuacgacuuucaggggagcgugcagaaagagagaaguaggcugcuuaagggcaaagaaaucacagauauuaucaacgacaucaauaaccccgucguuaagcgcucugugucccaaaccguaaaagugauuaacgcaauaauccagaaguauggaagcccucaggccgucaauauugagcuggcucgggagaugucgagaaacuacgacgaaaggcgaaagauggagaaacagaugaaggaucgccaaucugaaaaugagcgggccaaaaaggagauccaggaauugggcaacgcauucccaacugggcaggacauacucaaauauagacuguggcacgaucaggacggaauuugcauguacuccgccaagaggauccccuuagcugagcuguucacaggugccuaugauaucgaccauauucuaccuuacucaaucaccuuugaugacaguuaccguaauaaggugcucguuacgagcgaagagaaccgccaaaaaggcaaucggauuccauaugaauacuucggguccgauucugagagauggagcaaguuugagacccuggugaacucaaggauacgagacuaucggaaacagcagaaucuuuugaagcagaguuucacagaagaggaacgcaaagaguuuaagcaaagaaaccugaaugauacuaaguacaucaccagggucauuuauaacaugauccgggaaaaucucgcacuggcgcccuacaacuccccgggcaaaaagaaacagguguucgcuguaaauggagguguuacagccuauuuacgaaagagaugggggaugagcgcaaaagaccgcucuaucgauacucaccacgccagggacgcuguggucauugccuguugcaccgacggcaugauacagaagaucucacguaacauucagggacgggagcugcuuuacgcaagaggcuuuacagcuguggaugucgagaccggggaaaaguucacuagggacgauuuuacgcgcgaccaaugggaugagaucuucggagugcagguuccuaaacccugggaauacuuuaacgaggaauuggacauucgacucggugagaauccaguggaguucaucgaaacacauagugauguaagcagaaagcuggacuauccugccugguuuuacgagaacaauauaauccggcccgucuucguguccaggaugccaaaccgcaaaguuaccggcgcggcccacgcugauacuauucguucucccagacauuaucaggaaaccgggucggugcuaacaaagaccgcacugaucgaccucaaacugaauaagaaaacuggagagauugagaacuacuauaagccugaaagcgauacacuuuuguacaaugcccugaaggagcgguuagaacucuauggcggugacgggaaaaaggcuuucgaggaaccauuuuacaaaccgaaggccgauggcuccaggggaaaccugguccgcaaagugaagacguacgacaaacuuacccugggcguauauguuaauucacaacacgggaucgcagcgaacgccaauggaaguauggugcgagucgacguguucagagugucuggcaaauacuauuuuguccccguuuacauagcugauguggugcggaagagguugccuaugaaagccguaguccaggguaagcaguauauugacuggaaagagauggaggauaaggacuucaucuuuagccucuacacucgcgaucugauuuccuucaagagcaaaaacgggaagaaagugacauguguugacggaaccucaaaggcagugaaugaagagaucgucuauuacuacggcgcuaacauaucuacagccuccuuuagugguaaaagccauaauggcucuuucgaauuuacuucccuagggauccagggacuggaguaucucaagaaguaccaaguggauguucugggcaacgugucagaaguaaaaagagagaagaggaugggguuccgguga

SEQ ID NO: 2830 - RNA, 3402 nt, Artificial Sequence
  Cas9 variant
augggcggguucgagguggacagaaagaucagccugggacucgauauuggugucuccucuguuggcuacucagugauagacguagauaccgggaaagugcuugaacugggaaguagguugaucaacggcaagauugguacagagaaucaggcccggcgcgaaaugcgagggacucguagauuaaucaacaggaaaaagcaacggcgcaaagacacggucaagcuguuuaaugaguucaagcuaauugauagcaaaaaggacgaacacuauuuugaucauuucgcuaacaauuccgaccccuacgagcucagagugaaaggacugucugagaaacuuucgcugucagaaaucgcagauggcuuguaucacauaguuaagaggcggggcaucagcuacgaccucaaggaugccgacgaggaaagugagggguccgaguaugaaaacggacugaagauuaauaacucugagcugaaaaaucagaccccugcgcagauccagcucaagcgcuuaaacgaauacggugcuauucgaggcaaaguggucaucgaugaggaaaagauacugcuuaauguguuuccaacaaaagccuauuuggacgaggcaaagagaauuaucgagaaacaaagggaguucuacccggggauucugacugaggaauuugaggaaaaguacugccagauccuaacccggaagcgugacuauuucguaggacccggcagcgagaaaucccgcacagauuacgguaucuauaaggaggacgggagaacccucaacaaucuguuugaagaacuuauuggacaugauaaaauauacccugaggaacugagggccucaggcgcuaguuucacugcacaguuguuuaacguucucaaugaccugaacaacuuacacaucagcucuuaugaagaucagaagcugacaaccgagaauaaagagcaaauuaucuccgaacucaagucaacgacuagcaacgugaauaugaugaaacuuauacagaagauugccggcugugaggaaagugacaucucuggguaccggaccgauaagaacuauaaaccagagaucuccagcaugcgaauuuaccgcaagguccauaaaaagcuguuggagucggaaaucgacauuacaaauuggcccgaugacuucauaaacaagcuaucuuuuauccugacucucaauaccgagaacggagaaauuagaaaucagcugaaaaacaggcuucagccugaguacgauuuccugacagacgaauugauccaaaccaucauugacaauaaggaguccuucgauauaaaaucaaacaauaaguggcaccgguuuaguaucaaaacgauggagcuccugauuccagaaaugaucaagcgccccguggagcagaugacuuuaauuaacgaaaugggucugaucaagaauagcggcaaaaaguucuccaacuauaaauaccuaccuuauaagaaaauagcugaggacaucuacaacccaguggccucuaagagcgucagagaagcgcucaaaauuguuaaugcaauccugaaggaguaugggcacauugaguacaucgugguagaaaugccgagggauaagaacgaggacgaagccaaagaucagauagagaaguuucaaaaagcuaauggacgucuuaaggacgccgcauuggaagaguucacagaggcuauuggcgauaaaucaaccguggacaagaagcuggguguccaucggaguaaacuccuguuuaagauccgacuuugguaucagcagagagggauggaucuguacgaaggcaaacccauuuccgccguggacuugcucaacaauccugauagcuuccagaucgaccacauaaucccacaaucuguuucauuugaugacaguuucaacaauaagacucugugcaacagcggauuaaaucagauuaaagacaagaagacacccuuugaguacaugaacgaaggcuaugggcagggauucgauuccaugaaagcgauggugaugaagaauccuaggaucgaccauaacaaacgcaagaauuaccuguuuucugagaacgucucggauauugagacccggaaaagauucaucagcaggaaucuaguggacacgcgcuaugccucccgaguaguucucaacaaccugcaggaauuuuucaaggagaaggaaucagauaccaaaauaaguauuauccgggguaaguucacaucuaaucuucguaaacacuggaagaucaacaaaaauagagacacuuaccaccaucacgcaauugaugcuaccaucauugccgcuacaccauuuuugaacauauggaagaaaggcagcuccaucuuccccucaaauguggagagcgaagacuuuuucgauauuaagacugggaagaucauuggaaacgacgaguuuaauaaauaugccuacgaugagccguauaacggcuucuacaaugaacugaggaacgcaaccgaccgcaucaaguuuucucaucaaauagauaaaaagaugaaucggaaagucuccgacaguacaaucuacagcaccagaguggccaagucuccuaagaacaaaaaggaguccgaauauauugucgcuaaaaucaagaauauuuacgacgcggaugaguaugcaaaauucaagaggaucuacgacaaggauaaaacuaaguuucuccugaacaaauaugacccccgaucauucaaucacuuagaaaagauaaugaacacguacccagauaguauugagcgcacaaugagcaacaauaaagugaagguugugcggaucucgccuuuugagcuguauagacaggaccauggucccguaaagaaauacuccaagaaaaacaaugggccagaaaucaagcagcuuaaauacuuggauaagaaggucggcucuagcauugacgugacccccgauaacgccaaaaauaagcacguuauacucaaaucacugaagccuuggaggacugacaucuaucuaaaccacgagaccggagaauacgagauuaugggcaucaaauauagugaucugaaguucaauaaaggggaaggauacgguauuaagaaggcuaaauaucucgagaucaagcaucgugagaaaguguccgacgacucugaauuuauguucacacuguacaagaaaaaccgcauaaaggucgagaauauggaaaccgaugagagcguggagaugcuuuucuggucccggacuauggacucacagaagggcuaugccgaauugaaaccaaucuacaaguacaaaacagaggaugacaacuggccgauuuaugggaaugcaaagaaacaaaucauuaagaagcugauccccaaaaacuguaagauauggaaaguaaauacggauguguuaggaaacccuuuuuacguugaaaaggagggcgaauauccaaaagacguccucgauuga

SEQ ID NO: 2831 - RNA, 3405 nt, Artificial Sequence
  Cas9 variant
augaacggccuggugcucgggcuugacaucggaauugccagcgucgguguuggcauacuggagaaaaauuccgggaaaaucgugcacgcuucuucaagaauuuuccccgcagccaccgcggauaacaauguagaaaggcggaagaaccgccaggcucgacguuugcauagaaggaaaaagcaccggggagcccgcuuaaaagaccuguuugaguacuauggccuacucacagauuucaguaaggugagcaucaaucugaacccuuacagacuuagggucgacggucuggaucaacaguugacuaaugaagaacucuuuauugcacugaagaacaucgugaaacggcgcgggauauccuaucuggacgaugccucugaagacggaggcacgguuucgucagauuacggcaaggcuguggaggagaaucgaaaacucuuagcagaacagaccccagggcagauccaacuggagagauucgaaaaguauggacagcuuaggggugacuuuacagucguggagaacagcgagaaaugccgguugauuaauguauucaguacuuccgccuacaagaaggaagcugagcguauccugcgcaaacagcaggaauuuaacaaucaaauuaccgaugaguucaucgaagacuaucuaaagauacucacaggcaaaagaaaguacuaccaugggccgggaaacgagaaaucuaggaccgauuauggccgguuucgaacugacggugccacacuggacaauauuuucgggauccuuauuggaaaguguaccuuuuaccccaacgaguaucgcgcgagcaaagcauccuacacggcccaggaguucaaccuguugaaugaucucaacaaucugacuguuccuaccgagacaaagaaguuaucagaagaacagaaaaagacuaucaucgaauaugcuaaaagugccaagacccugggcgcaagcacacuccuuaaauacauugcuaagaugauagacgccucuguggaucagaucagaggcuauagggucgacgugaacaauaagccagagaugcacaccuuugagguguaccggaaaaugcaaucccuggaaacgauuucagucggggaguugagccgcaacauccuagaugaacuggcgcauauacucacucugaauacagagagagaaggaauugaggaggccaucaacaccaagcuaagggacaguuucucucaggaucagguucuggaauuggugcaauuccguaaaaauaacuccagccucuuuucgaaggguuggcacaauuucucucugaaauuaaugauggagcugauccccgaacuauacgagacuuccgaggaacagaugacaauucucacccggcugggcaagcagaagucaaaagagacgaguaagcgaaccaaauauaucgacgaaaaggagguaacagaagagauuuacaacccuguggucgcaaaaagcgugagacaggcuauaaagaucauuaaugaggccacuaagaaacacgggaucuuugauaacaucguuauugaaauggcuagggagaauaacgaagaggacgccaagaaagauuauauaaagcgccaaaaagcaaaccaggacgaaaaguacgccgcuauggagaaagcggcauuccaguauaauggaaagaaggagcuuccagacaacaucuuucauggccacaaagaauuggccaccaagauucggcuguggcaucagcaaggugagaaaugccucuacacagggaaguccauccccauuucugaucugauccacaaucaguauaaauacgaaauagaccacauccuuccucugagcuugucauucgaugacagucucuccaacaaggugcuggucuuagcuacugccaaucaggagaagggccagagaaccccauuucaagcacuggauagcauggacgaugccuggucuuacagggaguucaaaucauaugugaaggagaguaaacuacucggaaacaagaaaaaggaguaccugcuuacagaagaggacauuagcaagaucgaaguaaaacagaaguuuauugagcgcaauuugguugauacccgauauuccucucgggugguccugaacgcucuccaggacuucuacaaaaaucauaacuuugauacuacgaucucggugguccguggccaguucacaagccaacugagaaggaaguggggguuagagaaaucccgcgaaaccuaucaccaucacgccguggacgcacugauaauugcggcuucaagucagcuucgguuguggaagaagcagaauaacccgcucaucgccuacaaagagggacaauuuguugauucucagacuggugaaauuaucagccugaccgacgacgaguauaaggaacuuguguucaaagcacccuacgaucauuucguagacacacuguccucaaagaccuuugaggauagcauacucuucucuuaccaggucgacuccaaauuuaauagaaagaucagugaugccacuauuuaugcuacaaggaaagccaagcuggacaaggagaaaaaggaauacacguauacccuuggcaaaaucaaggauauuuacagcuuggggacuaaaacaccuucuaagaccggauucuauaaguuucuggacuuauacaacaaagauaagucccaguuccucauguuucaaaaagaccgaaagacaugggaugaggugaucgaaaagauaauggagcaguaucgcccauucaaggaauacgacaaggcaggcaaacugguugauuuuaaucccuucgagaaguaccggcaggagaacgguccuauuagaaaauauucaaagaaagggaacggcccagaaaucaagagucuuaaguacuaugacauccuguugggaaaacacaagaauauuacucccgagggcagcaggaacaccguggcucuccugucgcuaaauccguggcguacggacgucuacuauaacauggaaaccaaaaaguacgaguuucuggggcucaaauaugccgaucugccuuucgaagagggaggugcguacggcaucuccacagagacuuacaaugaacuucgcgagaaggaagggauuggaaagaacucugaguuuaaauucaccuuguauaagaaugaccugauauuaaucaaagauacagagacuaacugucagcaauucuuucgguucuggagcagaaccggcaaggacaaucccaaaucauuugaaaagcacaaaauugagcucaagccauacgaaaaggccaaauucgagaagggugaggaacuggaggugcuugggaaaguaccucccaguuccaaccaguuucagaagaauaugcagaucgaaaaccugucuauuuauaaagugaagacggauguucuaggcaauaagcauuucaucaaaaaggagggagacaaaccaaagcucaaauuuuga

SEQ ID NO: 2832 - RNA, 3405 nt, Artificial Sequence
  Cas9 variant
augaacggccuggugcucgggcuugacaucggaauugccagcgucgguguuggcauacuggagaaaaauuccgggaaaaucauucacgcuaacucuagauuguuccccgcagccaccgcggauaauaacguggaaaggcggaagaaucgccaggcucgacguuuaaacagaaggaaaaagcaucggggaguacgcuuucaagaccuguucgaggauuacggccuacucacagacuuuucaaaagugaguaucaaucugaacccuuauagacuuagggucgauggucugaaucagcaguugacuaacgaagaacucuucauugcccugaagaauaucgugaagcggcgcgggauaagcuaccuggacgaugcauccgaagacggaggcgccguuucuucggauuauggcaaagcuguggaggagaaccgaaagcucuuagcagaacagacgccagggcaaauccagcuggagagauuugaaaaauacggacaggucaggggugacuucaccgugguagagaauggcgagaaacuucgguugauuaacguuuucucaacaagcgccuauaaaaaggaagcugagcguauccugcgcaagcagcaagaauuuaauaaccagauuacugaugaguuuaucgaagacuaccuaaaaauacucaccgggaagagaaaauauuaccacggaccgggcaacgagaagaguaggacagauuacggucgguuccgaaccgacgggacuacacuggacaauauuuuuggaauccuuauuggcaaaugcaccuucuaucccgaggaauaccgcgccuccaaggcgucuuauacggcacaggaguuuaaccuguugaaugaucucaacaaucugacugugccuaccgaaacaaagaaguuaagcgaggaacagaagaaagucaucguggaguacgccaaggaggcuaaaacucugggcgccuccacccuccuuaaguauaucgcaaaaaugauugacgcuucaguggaucaaauaagaggguacagggucgacguuaacaauaagccagaaaugcauacauucgagguguaucggaagaugcagagucuggaaaccaucagcguaggagaguugucucgcaacgugcuagaugaacuggcccacauucucacgcugaauacugagagagaggguauggaagaggcgaucaacacaaaacuuaaggacuccuucucacaggaucaaguccuggaauuggugcaguuuaggaaaaauaacagcagucucuucucuaagggcuggcauaauuuuucccugaaauuaaugauggagcugauacccgagcuauacgaaaccagcgaggaacagaugacuauucucacacgucuggggaagcagaagucgaaagagaccucuaagcggacgaaauacaucgacgaaaaggagcuuaccgaggaaaucuauaacccuguuguggccaaauccguccgacaagcaauuaagaucauuaaugaggcuacaaagaaacacggaauauucgauaacaucgugauugaaauggccagagagaacaaugaagaggacgcuaagaaagauuacaucaagaggcagaaagccaaccaggacgagaagaaugcagccauggaaaaagcugcguuucaguauaacggcaagaaggaguugccagacaauaucuuccacggucauaaagaacuggcaacuaagauucgccucuggcaccaacagggggagaaaugucuguacaccggcaagacaauacccaucucagaucuuauucauaaccaguauaaauacgaaaucgaccacauucugccuuugagucucagcuuugaugacucccugucuaauaagguauuaguucuggccacugcuaaccaggagaagggacaacggaccccauuccaggcccuagauagcauggacgaugcauggucauauagagaguuuaaaaguuacgugaaggaauccaaacuccugggcaauaagaaaaaggaguaccuuuugacagaagaggacaucagcaagauagaggucaaacagaaguucaucgaaaggaaccugauugauacccgcuauucuucacgagugguccucaaugcccugcaggacuuuuacaaagcucacaaguucgauacuacgaucagugugguucgggggcaauuuacaagccaguuacguagaaaauggggacuggagaaguccagggaaaccuaucaucaccaugccguggacgcacuuauuaucgcggcuucuucgcaguugcgccucuggaagaaacaaaacaauagccugauauccuacaaggagggucaguucguagauucagaaacuggcgagauuaucagucuaaccgacgacgaguauaaagaacuggucuucaaggccccguacgaucacuuuguggacacacuccggucuaaaaaguucgaggauagcauucuguuuuccuaucagguugacucaaaauucaacagaaagaucagcgaugcaaccauauacgccacuaggaaggcuaaacuugacaaggaaaagaaggaguacacauauacguuggggaaaaucaaggauauuuacucucugggaaccaaggcccccuccaaaacuggcuuuuauaaguucuuagaccucuacaauaaagauaagagucaguuucugauguuccaaaaagaccgaaagacaugggaugaagugaucgagaagauuauggagcaguaucgcccuuuuaaagaauacgacaagaccgguaaacuugucgauuucaacccauuugagaaguaucggcaggaaaacgggcccaucagaaaauacagcaagaagggcaauggaccugagauaaaaucucugaaguacuaugacauuuugcucggcaaacauaagaacaucacaccagaaggguccaggaauacuguggcacugcuaucacugaaccccuggcguaccgacguauacuauaauauggagacgaaaaaguacgaguuccucggacugaaguaugcugaucuuccguuugaagaggguggcgccuacgggaucaguaccgaaacauauaacgaguugcgcgagaaagaaggaauuggcaagaauagcgaguucaaauucacucuguacaagaacgacuuaauccucauuaaagauaccgaaacaaauugccagcaaauauuucgguucuggucgagaacugguaaggacaacccuaaauccuuugagaagcacaagaucgaacugaaacccuacgagaaggcgagguucgagaaaggggaggagcuuaaggugcugggcaaaguuccaccuucuagcaaucagcuacagaagaacaugcagauugaaaaucucucaaucuauaaggucaaaaccgaugugcugggaaacaagcacuuuauuaaaaaggagggcgacgaacccaaauugaaguucuga

SEQ ID NO: 2833 - RNA, 3405 nt, Artificial Sequence
  Cas9 variant
augaacggccuggugcucgggcuugacauaggaauugccagcgucgguguuggcauacuggagaaaaauuccgggaaaaucauucacgaaaacucuagauuguuccccgcugcaaccgccgauaauaacguggagaggcggaagaaucgccaggcgcgacguuuaaacagaaggaaaaagcaucggggaguacgcuuucaagaccuguucgaagauuacggccuacucacagacuuuucaaaagugaguaucaaucugaacccuuauagacuuagggucgauggucugaaucagcaguugacuaacgaggaacucuucauugcucugaagaauaucgugaagcggcgcgggauaagcuaccuggacgaugccuccgaggacggaggcacgguuccaucugauuauggcaaagcagugaaggagaaccgaaaacucuuagccgaaaagaccccggggcagauccaacuggagagauuugaaaaauacggacagcuuaggggugacuucacagucgaggagaauggcgaaaagugccgguugauuaacguguuuucgacuucagcuuauaagaaagaggcagaacguauccugcgcaagcagcaggaguucaauaaccaaauuaccaacgaauuuaucgaggauuaccuaaaaauacucacagggaagagaaaauauuaccacggacccggcaaugaaaagagcaggaccgacuacggucgguuccgaacugaugggacaacccuggacaacauuuuuggaauccuuauuggcaaauguacguucuauccugaagaguaccgcguaaguaaggccuccuauacugcucaggaauuuaauauccugaacgacuugaauaaccucaccguuccaacagagacuaagaaacugucugaggagcagaagaaagauaucguggaguacgccaaggaaaccaaaacauuaggcgcgagcacccugcucaaguauauugcaaagaugauagacgccuccgucgaucagaucagaggguacaggguggacgugaauaacaaacccgagaugcauacguucgaagucuaucggaagaugcaaucacuugagacuauuaguguuggagaacugagccgcaauguguuggaugagcuagcucacauccugacacucaacaccgagagagaagguauagaggaagccauuaauacuaaacugaugggcguauucucucaggaccaggugcuugagcugguccaauuuaggaagaacaauuccucauuguucagcaaaggguggcauaacuuuagucucaagcugaugauggaguuaaucccugaacuguacgagacaucugaggaacagaugaccauccuaacgcgucucggaaagcagaaauccaaggaaaccagcaaacggacaaaguacauugaugagaaagaggugacugaagagaucuauaauccaguuguggcaaagucgguccgacaggcuauuaagauaaucaacgaagccaccaaaaaguacggcauuuucgacaacaucgugaucgagauggcgagagaaaauaacgaggaggaugccaaaaaggacuauauuaaaaggcaaaaggcaaaucaggaugaaaagaacgcugccauggagaaggcugccuuucaguacaaugguaagaaagaacugcccgacucuauauuccacgggcacaaggagcuugcaacaaaaauccgcuuguggcaucagcaaggcgaaaagugccuguauacuggcaaaaacauuccuaucuccgaccucauucacaaucaguacaaguaugagaucgaucauauacugccacuuucacugaguuuugacgauagcuuguccaacaagguacucguucuggccaccgcuaaucaggagaaaggacagcggacaccguuccaagcguuagacucuauggaugacgcauggagcuacagagaauuuaagucauacgugaaagauaguaagcugcuauccaacaaaaagaaggacuaucuccugaccgaggaagauaucagcaaaauugaggucaagcagaaauucaucgagaggaaucuuguggacacucgcuacucuucacgagucguguugaacgcccugcaggauuuuuauaaggcucacaaauucgacacgacaauuaguguugugcgggggcaguuuaccagccaacuccguagaaaguggggacuggaaaaguccagggagacuuaccaccaucacgccguagaugcauuaaucauagccgcuucuucgcagcugcgccuuuggaaaaagcagaauaaccccuugauuaccuauaaagaaggucaauucgucgacagcgagacaggcgaaaucauuucccucaccgacgaugaguacaaggagcugguguucaaagccccuuaugaccauuuuguugauacucuacggucaaagacauucgaagacaguauccuguuuucuuaccagguggauagcaaauucaauagaaagauauccgacgcaacgaucuacgcgaccaggaaggcuaaacucgauaaggagaaaaaggaauauacuuacacacuggggaaaauuaaggacaucuauucacuuggaaccaagacaccaagcaaaacuggcuuuuacaaguucuuggaucuguauaacaaagacaagucucaguuuuuaauguuccagaaagaucgaaagaccugggacgaggucauugaaaagaucauggagcaauaccgccccuuuaaagaguaugauaagacggguaaacucguggacuucaacccuuuugaaaaguaccggcaggagaaugggccaauauguaaauacuccaagaagggcaacggacccgaaauuaaaagucugaaguauuacgacauccuucugggcaaacacaagaauaucaccccggaggggagcagaaacacaguagccuugcucucucugaauccuuggaggacugauguguauuacaacauggaaaccaaaaaguaugaguuccuaggacugaaguacgcagaccuccccuuugagaaagguggcgccuaugggauuuccacagaaacuuacaauaagcugcgugagaaagaaggaaucggcaagaacucagaguucaaauucacccuuuacaagaaugauuugauucugauaaaagacacggagacaaacugccagcagaucuuucgcuucuggagucggaccgguaaggauaauccaaagagcuuugaaaaacauaagauugaguuaaaaccuuaugaaaaggcuagauucgagaaaggggaggaacucgagguucugggcaaggugcccccaucguccaaccaauuucagaagaauaugcagaucgaaaaccuuucuauuuacaaagucaagacugacgugcugggcaaaaagcacaucaucaaaaaggagggagaugaacccaagcuaaaauucuga

SEQ ID NO: 2834 - RNA, 3405 nt, Artificial Sequence
  Cas9 variant
augaaguacaucgagagcguguccauuggcuucgacauaggggucggaucuguugguuaugccgugaucaacucaaaaaccaagcagauucuggaaaguggcguaagcaucuuucccgcugcaguggcccagaaaaaugucgagagaagggaaucccggcaaucucgccgacuccguagaaggcgggugaaccgccuuaaugaucugaagaaauuguuaaagaagaacggguucauuccuucgccaaauaaaaacccguacgagaucagaguuaggggacuggaacaccagcuaucacgggacgagauagcgaucgcugugcuccauauugccaagcgccgaggcaucagcuauagucuggaugacgucguggaugagaauguaacagacuuuaaagguaagauugccaaaaaccaggaagcacuuaagaauaagacucccggggagauccaauacgaaagacuguugaaauauggaaagguuaggggcacggugaccaacuacgucgaguaugaugagcagccugaauacuuccucaauguguuuccaaacuccgcuuacguggacgaggcaaaacggauacugacaugccagaagcaguauuaccccgaaauuacugaugaccugaucgagaauauugucaaaaucaucucucguaagcgcgccuauuacauuggcccugggaacgagaaaagcagaaccgauuauggaauauacaggacaaauggugaaacccucgagaacaucuucgaaauuuuaaucggcaaggacuccguuaacccagaugagcugcgggcucccgccaauucacuuacugcgcaaguguauaacuugcugaaugaccuaacaaacauacgauacaaugggagugaacgccucaccccugagcagaagcaggacauucugagcgaacuucugacgacugagaaaaccguacagauguugaacgugaucgcaaagaaagucaaugugaagaaagaggaaaucucuggauuuagaacaaagaaggaugacaaaccagauuuccacacucucgagguuuacaggaaggugcggaaacauaugcugaacaagggcauugacaucaaugaauggccgaccgaguguuuugaugaauuagccuucauuuuuaaccugaauacagagauaggugagauccgcaacagaauuuccgaaaaagucgugcccaaguaugacuucaucaccaaucaaaucguagaugaccuccuugaggauccuaagauuuuugcuauaucaacgagccagaaauggcacagguucaguaucaagacuaugaacguucugauuccagaauugcuaaauggguacaacgagcagaugacaauccugacccguaugggacuccuggaggacucuaaaaacgauuauuccaauauugacaagaucgacaucaaaaacgugacugaaaauauauacaaccccgucgugcgaaagagcauuaagaaaugccuuaagaucuucaaugagcuguauaaaaaguacccuaacauuucggaugucgugaucgaauugccacgggaggacaaucccgaagaugccagaaaacucauaaagaaaaugcaaaaggagaaccugguugagaaggacacaucuuuagaagcauuuaggaaagaggcuaaucuguccgaaaacggccuaauugauuuccuccgcaagggcaaaaaucgggcccugaagaucagacuuugguaucagcaggaggggaaauguuuguacaccggagaaccgauucuggcggaggaccucugcaagaacgaggccaauuacgauaucgaccauauaaucccuauuucagugaguuuugaugacagcaucaacaauaagguacuguguuccucucacuucaacagguuugaaaaagagaagaaaacgcccuucgaauauuuuagcaacaagucaagucaccuuggucgcuacuccaauuucgaugaguuucgagcaagcgucaacgcuaauaaacggauuucugacgugaagcguaagaaccuguugucaaaagaacuccugagugauuuagacaccagaaagaaauucaucgccaggaaucugguugacacacgcuaugcuagccggguggucuuuaacgagcuaacucaguucuuugccuccaagaaagcagauaccaagguggccguaauaagaggcaaguucacaucucaacucaggcgagcuuggcagcugaauaaaucgcgcgacacuuaccaucaccaugcgguggaugcagcccuuauugggguuaccccauucuugaagaucuggcggagcggaaaaacaaucuauccuagaaagaugaccgaggcucagacugacuuugaacugaacgagauuacgacaaaugaugaguucaaagaauccuacuaucagcuccccugcccacaauuucuggacuacuuaacccagaugcaggagaaccugaagaucaauuucgaagucgauaaaaagaugaacaggaagauuucagacgccaugauauacaguucucguaaaaagaaacuuagcaaggauaaaaaggagaaggaauauuccuugggcacuaucaaugacauuuacucagaugcagguuauagcaaauuuaagaacaucuacaaaaaggacaaagagaaguuccucauguaucaccuggaucacaagucuuuugaaauucuagaggacaucauaucccaguaccccgacaaagaggaauauaucgauagugaggggaaggugaaacaacgcgccgugagcccuuucgaaauuuaccggagaaaguacggcuauaucaggaaauacucuaagaagaauaacggaccaauuaucaaaaacaugaaguauuacaaugagaaccugccgaaaauauauauugacaucacccccaagcaguccaucgauaaaaaggucuaccucacaaauauuucaccuuggcgaaccgacguuuauuacaaccggagucagaauagcuaccauauaaugggcaucaaguauucggaucugcgcuacauugacgggaaauauggaaucccaaagaacguguacgaaaagauuaaacuuagagagaaaauccccuccgagucugaauuuuguuucagcuuguauaagaaugauagggugaaaauaaucgacccuaacaagaaugaggaaauugagcugcgguuuaacucacgaacuuuaccaaguguacucaauuacgucgaguucaagccccuguuucaggaauccuauaacucucuuacacuguugccgguguucagcaaaacgaccuccgaggguagaaucauuaagaaauucacucgcgaagauaauaucguuuacaaggugaacacagacgagcucggcaauccuuacuauauacugaaagaaucacaaaacccaaagaauauuaucgauaacagcaacaagaccgaguga

SEQ ID NO: 2835 - RNA, 3405 nt, Artificial Sequence
  Cas9 variant
augaacggccuggugcucgggcuugacaucggaauugccagcgagggugucggcauacuggaaaagaacuccgggaaaaucauucacgcuaauucuagauuguuccccgcagccaccgcggauaauaacguugagaggcggaagaaucgccaggcucgacguuuaaacagaaggaaaaagcaucggggagugcgcuuucaagaccuguucgaagauuacggccuacucacagacuuuucaaaaguaaguaucaaucugaacccuuauagacuuaggguggauggucugaaucagcaguugacuaacgaggaacucuucauugcccugaagaauaucgucaagcggcgcgggauaagcuaccuggacgaugcauccgaggacggaggcgccgugucuucggauuauggcaaagcuguugaggaaaaccgaaagcucuuagcagagcagacgccagggcaaauccagcuggaaagauuugagaaauacggacaggugaggggugacuucaccgucguggagaauggcgaaaaacuucgguugauuaacguauuuucaacaagcgccuauaaaaaggaggcugaacguauccugcgcaagcagcaagaguucaauaaccagauuacugaugaauuuaucgaggacuaccuaaaaauacucaccgggaagagaaaauauuaccacggaccgggcaacgagaagaguaggacagauuacggucgguuccgaaccgacgggacuacacuggacaauauuuuuggaauccuuauuggcaaaugcaccuucuaucccgaagaguaccgcgccuccaaggcgucuuauacggcacaggaauuuaaccuguugaaugaucucaacaaucugacuguuccuaccgagacaaagaaguuaagcgaggaacagaagaaagugaucgucgaguacgccaaggaagcuaaaacucugggcgccuccacccuccuuaaguauaucgcaaaaaugauugacgcuucaguggaucaaauaagaggguacaggguggacgucaacaauaagccagagaugcauacauucgaaguuuaucggaagaugcagagucuggagaccaucagcgugggagaauugucucgcaacguacuagaugagcuggcccacauucucacgcugaauacugagagagaagguauggaggaagcgaucaacacaaaacuuaaggacuccuucucacaggaucaagugcuggaguugguccaguuuaggaaaaauaacagcagucucuucucuaagggcuggcauaauuuuucccugaaauuaaugauggagcugauacccgaacuauacgagaccagcgaggaacagaugacuauucucacacgucuggggaagcagaagucgaaagaaaccucuaagcggacgaaauacaucgacgagaaggagcuuaccgaagagaucuauaacccugugguugccaaauccgugcgacaagcaauuaagaucauuaaugaagcuacaaagaaacacggaauauucgauaacaucgucauugagauggccagagaaaacaaugaggaggacgcuaagaaagauuacaucaagaggcagaaagccaaccaggacgaaaagaaugcagccauggagaaagcugcguuucaguauaacggcaagaaggaauugccagacaauaucuuccacggucauaaagagcuggcaacuaagauucgccucuggcaccaacagggggaaaaaugucuguacaccggcaagacaauacccaucucagaucuuauuuauaaccaguacaaauaugagaucgaccauauucugccuuugagucucagcuuugaugacucccugucuaauaagguguuagcccuggcuacugccaaccaggagaagggacaacggaccccauuccaggcacuagauagcauggacgaugccuggucauacagagaauuuaaaaguuacguaaaggaccucaaaucccugagcaauaagaaaaaggauuaucuuuugacagaggaagacaucucuaagauagagguuaaacagaaguucaucgagaggaaccugguggauacccgcuacucaagucgagucgugcucaaugcucugcaggacuuuuauaaaagccaccaauucgauacuacgauuuccgucgugcggggccaguuuacaucucaguuacguagaaagugggggcuggaaaaaucgagggagaccuaccaccaucacgccguugacgcacuuaucauugcggcuagcucccaauugcgccucuggaagaagcagaacaauccgcugaucacuuauaaagaaggacaguucguggacucacagaccggugagauaauuagucuaacagaugacgaauacaaggagcugguauucaaagcccccuaugaucauuuugucgacacccucucuagcaagacuuucgaggauuccauccuguuuucauaccaaguggacagcaaauucaaccggaagauuucugaugcaacaaucuacgccacgagaaaagcuaaacuugacaaggaaaagaaggaguauaccuacacuuugggcaaaauaaaggauaucuauucccuggggacaaaaaccccuaguaagacaggauuuuacaaguucuuagaccucuauaauaaagauaagagccaguuucugauguuccagaaagacaggaagacuugggaugaaguuauugagaaaaucauggaacaguaccgaccauuuaaggaguaugacaagaccggcaaacuuguggacuucaaccccuuugagaaguaccgccaagaaaacgagccuauucggaaauacucuaagaaagguaaugggccagaaaucaagucccugaaguauuacgauauauugcucggcaaacacaagaacauuacgcccgagggaucaagaaauaccgucgcccugcuaagucugaacccguggaggacagacguguauuacaauauggaaacuaaaaaguaugaguuccucggccugaaauacgcagaucuuccuuuugaggaagggggagcuuaugguaucagcaccgagacauacaacgaauugcgugagaaggagggcaucgggaaaaauucggaguucaaauucacucuguacaagaacgacuuaauucucaucaaagauaccgaaacgaauugccagcagauuuuucgcuucuggucccggacaggaaaggacaaccccaaaucuuuugaaaagcauaaaauagagcugaagccauaugaaaaggccagauucgagaaaggcgaggaacuugagguacuggguaaggugccucccagcucaaaucagcuacaaaagaacaugcagaucgaaaaucucaguauuuacaagguuaaaaccgauguccuggggaacaagcacuuuaucaagaaagagggcgacaagccaaaauugaaguucuga

SEQ ID NO: 2836 - RNA, 3408 nt, Artificial Sequence
  Cas9 variant
augagcgaccuggugcucggccuugauauagggauuggauccgucgguguuggcauacugaacaaggugaccggggagaucauucacaaaaauucuagaaucuuccccgccgcucaggcagaaaacaauuuggagaggcggacaaaccgccaaggacgacguuuaacuagaaggaagaaacaucggcgcguaagacugaaucaccuauuugaagagucaggccucauuacggacuucaccaaggugaguaucaaccugaauccuuaccagcuuagggucaaaggucugacagccgaauugagcaacgaggagcucuuuauagcgcugaagaauauggugaagcaucgggggaucuccuaucuggaugacgcuucugaugacggaaacucgucaguuggcgauuacgcccagauugugaaagaaaauagcaagcagcucgagacuaaaaccccaggccaaauccaguuagaacgcuaucagaaguacgggcagcugcgaggagacuucacagucgaggaggaugguagaaaacacaggcuuauuaacguguuuccgaccagugcauaucaugccgaggcuuugcggauccugcaaacucagcaggaguucaauccccagauaacagacgaauuuauuaacuccuaccuagagauccucaccggcaagcguaaguauuaccacgggccuggaaaugaaaaaucucgcacggauuacggcaaguauacuaccaaaaaggacgcacaaggucaguacauuacacugaacaacaucuucgggauccuuauuggaaaaugcacuuuuuauccagaggaguacagagccgcuaaggccagcuauaccgcgcaggaguucaaucuguugaacgaucucaauaaccugacaguacccaccgaaacgaaaaaguuauccgaagaacaaaaguaccagauaaucacuuauguuaaaaaugaaaaggcaaugggcccugccaaacuguuuaaguacauugcuaaacuccuugccugugacaucgcagacauaaagggcuacaggauugauaagucagacaaagcugagauccacacauucgaggccuaucggaagaugaaaacccuggaaacuaucgauauugagcagaucgaacgagagaaguuggacaaacuagcguacgugcugacacucaacaccgaacgcgaggggauucaggaggcccuggaucaugaauuugcagacggaacguucagucaagagcaggucgaugaacuugugcaguucagaaaggcuaauagcucuauauuugguaagggcuggcacuccuucucagugaaacugaugauggaguugaucccagagcucuaugccaccagcgaggaacagaugacaauucugacuagguuagggaagcaaaagaccacaaguucuuccaacaagacuaaauacaucgacgaaaagcagcugaccgaggaaaucuauaaucccgucguugcuaagagcgugcggcaggccauuaaaauaguaaacgcagccaucaagaaauacggagauuuugacaauauugugaucgagauggcucgcgagacaaacgaagaugacgagaagaaagcgauucagaagauccaaaaagcaaauaaggccgaaaaggacgcugccaugagaaaagcagccaaccaguauaauggcaaggcugagcuaccucauucggucuuccacggucacaaacagcucgccaccaagauaaggcuguggcaucagcaaggggaacguugccuuuacacuggcaaaacgaucucuauucacgauuugaucaacaacccaaaucaguuugagauugaccauauccugccgcucuccauaacauucgaugacucacuggcaaacaaggugcuuguuuacgcgaccgcuaaucaggagaagggacaacggacucccuaucaggcccuggauaguauggacgaugcauggagcuuucgagaauugaaagccuucgugagagaguccaaggcucucucuaacaaaaagaaagaauaccuguuaaccgaggaagacauuagcaaguuugaugucaggaagaaauucaucgagcgcaaucugguggacacacgguaugccucaagaguaguucuaaacgcacuccaggagcacuuuaaggcucauaaaauugauaccaaggugagugucgugaggggccaguucacuucccaacugcgccgacacugggggaucgacaaaacacgggauacguaccaccaucacgccgucgacgcgcuuauaaucgccgcuagcucucaguugaaucuguggaagaagcagaaaaacacccucgugucauauagugaagaccagcuguuagauauugagacuggagaacugaucagcgacgaugaguacaaggaguccguuuuuaaagcaccuuaucaacauuucguggacacacuuaagucuaaagaguucgaagauucgauuuuguuuagcuaccagguagacuccaaguucaaucguaaaaucucagaugccaccauauacgcuacaagacaggccaaggucgguaaggacaaaaaggaugaaacuuaugugcucggcaaaauuaaggacaucuacgcacuggggaccaaaacgccaaguaagaccggauuuuauaaguuccuagaucuguacaacaaagacaagucucaguuucucguuuaucaaaaagauaggaagacaugggacgaggugaucgagaaaauuauggaacaguaccgccccuucaaggagagcgacaagaauggcaaagaagucgauuuuaacccuuucgagaaguaucggaucgaaaaugguccaauuagaaaauacuccaggaaggggaacggccccgagauaaaaucacugaaguacuaugcgagcaaacuuggaaaucacaucgacauuacuccgaaagauucuaacaacaaggugguauugcaguccgugaguccuuggcgagccgacguuuacuuuaauaaaaccacaggcagcuaugaaauccugggguuaaaguacgcugaucuccaauucgagaaaggaacugguaccuaucgcauuucugaggaaaaguacaacgacaucaagaaaaaggagggcgucgauuccgacucagaauuuaaauucacgcuguauaagaaugaucuucuguugauaaaagacacagagaccaaggaacagcggcucuuuagauuccugaguaggagcaugcccaacaaaaagcacuacguggagcuaaagccauacucgaaagauaaguucgagaaaaaugaaucccugaucgagauucucgggucugccgacaagagcggacguuguaucaaaggccuggcaaagucaaaccuuaguauuuuuaaggugcgcacugacgucuuggguaaucagcauaucaucaaaaacgaaggggauaagccuaaacuggacuucuga

SEQ ID NO: 2837 - RNA, 3408 nt, Artificial Sequence
  Cas9 variant
augggcgugaucuuccuguacgagaacauugucaagcccuuuccuagcagauaugacaaagccauaaugaagaggcucaaagggcggcagaccaugggauacauccuuucccuggauauugguaucgcuucuugcggcuauucaguuuuggaaacagacgcauuaggggugccauacaagauuaaaacucugaauaguaucauauucacgcgcgccgagaacccgaagaccggagcgagccuagcugaaccccgacguaaguauagaggcgccaggcggcgcaaaagaaggacauccuuucggaagcaccgcacucgacaacucuucaucaccucuggucugcuuucgaaacaggauauugcaagauaccugaaucagcaggagccucaugacgauaucugggaauugaggguaaaggggcucgacgagccacugacaaaccugcaacucuuucagguguuauauuacuucgucacccaccggggauuuaaaucaaaucguaaggccgagcugaaggauaaagacauuggccccgugcuuaacagcaucaaugcuuucaaggaagagaugcagagucaugauuaccgcacuauaggcgaauuguaugcaaacgacccuagauuuagggaucggaaacacaauaaggacuacacaaacggguuccugggaaccauucagcgauccuggcuaguugaugagaucaaaaugcuccugacgaaucaacagucuuuugguaacacucagcuuaccagcgaguucauugaacuguauuugaauaucuuuacaucccagcgcaacuucgacgacggcccagccucagggcccuacaguggagaucucaucgacaagauggugggcccugauacuuucaauagaagcaggaaacgggcuccacgcgccaccuauacauuucaauacuucucuuuucuguccaaguuaaacucacugagaauugcgccgagcauaagugcacccuucgagacccucacggucgaccagagggcccuuaucacuaagcgucugugggguccugaugugaaaucugcugacuugaaguuuaaacagauucggaugguacuaucccugccagaaacagcccgauucaaccucguuaauuaugggaacacccccgagaaggcacuggaaaucgaggauaaaacuacauuuauaagcauuaagccucuuagagagaucgaaaaggcucugaccggaacgaccuugccagugucgcaugaccaacucgaugccaucgcgaggauucugacagucuacaaaucugacuccaaucgcaagacugccuuccacaaccagaccguguuaucagaugaggugaucgaacagcugcuaccccucaauuuuaguaaauucggccaccugagcgucgagacaaugcaggaaauuauaccguaccuugagcaaggcaugguuuauuccgacgcagcuacugccgcuggguacgacuuucggaacaaucagaucgauauggaguauauuagagacaacgugaccaauccuguagugaggcgcgccgucucuguggcaaacaaguugguuaaagccgugguccgacgguacggaaagcccgauagcauccauaucgaacuggcucgugaccucucacagaauuuccaggagagaaggcaagaugaagugcgccagcagaagaacgcgcgggacaaugagaaaauugcaaagagacuggaggaacuugguauaccaguaaacggcguuaauaucacaaaaaugaagcuguaugaugagcagcacgggauugacuuguacgaucucaguaccaacgccuccauggcugugacugacaucuuuagcgaugacagguaugaaauugaucauaucauaccuuacucugucucauucgacgacaguuacacgaacaaagugcuggucagcgccaaggcaaaucgagagaagcgcgaucggauccccauggaaguguucggaaacgacuccgagagaaggcgucaauuugagaaucgcguuaacacaaauauuaccaacuuacggaaaaagagaaaucugcuaaaagaaacuuucucugaugaggacaaggccaaauggaagucgaggaacaucaaugauacccgauaucucaaccggauucugaugaauuaccuuagccagaacguggaauuuacagacguauuguccgaugcuaaacacgucaucgcccugaauggcgcagugaccgcgaagauacgcucaagaugggguauuacuaagguuagggcugccggggaccuccaccaugcaguggaugccgucgugaucggcuguguaacagacgcucugauucaggccgugacgcgguaugcaaaauaccaggagcgaagagauaacaaggcugccgcggaacaagacuuagccgagaauaacccagaggaacuggaugcuaaacaguuccgcaagguuuuuaacgacuauccccuuccuuggccagaguucagggaagaguugaugggacgugucaguucugacccgagccagaucauggcaggccggcaauggucccacuacaccgccgaagagauaucagagcucaaacagcccuuuguggugagagucccuaaucauaggaucguugggccagcuacucuggauacaguguauggacagcccaacccugacgauggucuaauuacccagcgcgugcgaaucacagaccugaagccacaaaagaauaaagauggcgaagacauuaucaaggccggggcaaacguauacgagcucgcggccgauggaggcaauaaacuggucuacgaaagcauacuugacgcuuugcaaguggccgguggggauggcaagaaagcauuccccacuggaagacuguuaguucggucuccgauucaggacaucccuguggagaggguccgcgugaccuccaaggcuacgcucguugugccaguaggccccaagagugucgccgcaaacgggagcauggugcguaucgauguguauaaaaccccuaagaaauacgucuuuguucccauuuaugugagagacacaguaaaggccgaacugccagaccgggcuguggcgccugucaaacccuacucucagugguaucagcuucagccaaaggaucaguuccuguuuuccuuguucgccaaugaccucaucagguuuaagcacccgcgcggagugucaacuaaagagauucugaccgaugguagucaggagaagggcaaacgaacagacguugugggguacuucacuggagcagauauagcuaccgccagcaucgccauugaaggcccugacagaucguucuccgcucgggguaucggguuugcaucucuaaagaacgucgagaaacugacggugaauuauuucggcgaacuccauagcguucacgagacacaacccaugcaguuuaggggacagcgcggcuga

SEQ ID NO: 2838 - RNA, 3411 nt, Artificial Sequence
  Cas9 variant
augaacggccuggugcucgggcuugacaucggaauugccagcgucgguguuggcauacuggagaaggauaccgggaaaaucauucacgcuuccucuagauuguuccccgcagccacagcggacaauaacguggaaaggcggucaaaucgccagggacgacguuuaaacagaaggaagaaacaucggaguguacgccugcaagaucuauuugagagcuacggccuccugacugacuucuccaaacuuucuaucaaucugaacccuuaucaguugagagugcaggguauggaaaaucagcucacgaacgaggaacuguuuauugcucugaaaaauaucgucaagaggcgggggauaucguaccucgaugacgccucagaggauggaggcaccgugagcagugacuauggcaaggcaguugaggaaaaccgccgauuacugacagagaaaacuccagggcaaauccagcuugaaagauucgagaaguacggacaguugaggggugauuuuaccguggaggaaaauggcgagaaacggcgucugauuaacgucuucuccacaucugccuaucgcaaggaagcugagagaauccuaaggaaacagcaagaauuuaauaacaagauuaccgacgaguucaucgaggauuaccucacuauacugacagggaagcggaaauauuaccacggaccgggcaaugaaaagagccgaaccgacuacggucgcuuuagaacggaugggacuacccuugacaacauuuucggaauccugauuggcaaaugcacauuuuaucccgaggaauacagggcauccaaggccucauauacugcucaggaguucaacuugcucaaugaccugaacaauuuaaccgugccuacagaaaccaaaaagcugagugaggagcagaaaaagacgaucaucgaauacgccaagagcgcgaaaacucucggcgcaucuacacuucugaaguauauugccaaaaugauagaugcuuccguagaccagauccggggguaccgcguugaugugaacaauaagccagagaugcauaccuuugaagucuauagaaaaaugcaaucauuggagacuauuaagguggaagaacuacccaggaaggugcuggacgagcucgcccacauccugacacuuaacaccgaacgugagggaauagaagaggcaauuaauagcaaacugaaggauacguucaaccgggaccaggucuuggagcucguucaguuccgaaagaauaacaguucucuguuuuccaaggguuggcauaauuucagcuuaaaacugaugauggaacuaaucccugagcucuacgaaaccucggaggaacaaaugacaauccugacuagacuuggcaagcagaggucuaaggagaccuccaaacgcacaaaguacauugaugagaaagaauugacugaggaaaucuauaacccagugguagcuaagucagugcggcaggccauuaaaauaaucaaugaggcgaccaagaaguacgggauuuuugacaacaucgucaucgaaauggccagagagaauaacgaggaagaugcaaagaagaacuauauuaaacagcaaaaggcuaaucaggacgagaaaaacgccgcuauggaaaaggccgcauuccaguacaauggcaaaaaggagcugcccgauaacauauuucacggacacauggaacucgccacaaagaucaggcuguggcaucagcaaggugagaaaugucuuuauaccgggaagaauauucagaucagugaccugauucacaaccaguacaaauaugagaucgaccauauauugccucucagccuguccuucgaugacucuuuaagcaauaaggugcugguucuagcuacugcgaaccaggaaaaaggccaacgcacgccauuucaggcacucgauucaauggacgaugccuggaguuaccgagaguucaaguccuacgugaaggaaagcaaacugcuuggaaauaagaaaaaggacuauuugcugacagaggaggauaucucuaaaauugaagucaagcagaaguuuaucgagaaaaaccucguggacacccgguacucaagucguguaguucugaaugcuuuacaggauuucuauaagaaacaccaauuugacacuaccauuagcguggucagaggccaguucacaucccagcugaggcgcaaguggaaacuugaaaagucucgggauaccuaccaccaucacgccguggacgcauugaucauagccgcuucgagccaacucagacuguggaagaaacauaacaauccgcuaauuuccuauaaggaugggcaguuugucgacucagagacuggagaaaucgugagucugucuaacgaggaguacaaagaacucguuuucaaggcccccuaugaccacuucguggauacacugaggagcaaaaaguuugaggacuccauucuuuucucauaccagguagauagcaaauacaaucgaaagaucucugacgcaacgauauaugcgacccgcaaggcuaaauuggauaaggacaaaaaggaauacacuuauacacuggguaaaaucaaggauauuuacgccuuaggcaccaagacaccuuccaaaacuggguuuuauaaguuccucgaccuguacaaaaccgauaagagucaguuucuuauguaucaaaaagaccggaagacgugggaugaggucaucgaaaagauuaucgagcaguacagaccauucaaagaguacgacaagaacggaaaagaaguggauuuuaaccccuucgagaaguauaggauagaaaauggcccuauucguaaauacagccgcaaggguaacgggucuguuaucaaguccaugaaauauuacgacaaucuguugggcaaguuuguggacaucaccccaucagagaguaaaaaccccgucgcacuccugagccuaaauccguggcggacagauguguauuacaacccugaaacuagaaaguaugaguuccugggacucaaauacgccgaccugugcuuuggcaaagggggaucguacgguauuuccgagguaaaguauaauaaaaucagggaaaaggagggcauugggaaagaaucugaguucaaguuuacccuuuacaaaaacgauuugauacugaucaaggacacagagacuaauugucagcaguucuuccgauuuuggagccggaccggaaaagauaaccccaagucauucgaaaagcauaaaauugaguuaaagccauaugaaaaagcuaaguuugagaaaggcgaggagcucgaggugcuggguaagguuccucccaguuccaaucaauuccagaagaacaugcagaucgaaaaucuuucuauuuacaaagucaagacggacgugcuggggaacaaacacuuuaucaagaaagagggcgaugaaccaaagcuaaaguucaaaaaguga

SEQ ID NO: 2839 - RNA, 3411 nt, Artificial Sequence
  Cas9 variant
augaacggccuggugcucgggcuugacaucggaauugccagcgucgguguuggcauacugaagaaagauaccggggagaucauucacacaaauuccagauuguucucugcugcaacugccgacucaaacaucgaaaggcggcgccaucgaggaggcaagcguuuaacgagaaggaaaaagcaccggaguauucgccugcaugaucuauuugaggacagcggucuccugaccgauuucuccaaagugucuaucaaucuuaaccccuaccagcugagaguacaaggguuggacaaucagcucacaaacgaagaacuguuuauagcgcugaagaauaucgugaagaggcggggaauuucguaucucgaugacgcuucagaagauggcggcacugucagcagugacuacgggaaagccguggaggagaaccgcaaguuacuggcagaacagaccccuggacagauccaacuugaucgauucgagaaauauggucagguuagaggcgacuuuacaguggucgaaaauggggagaagaggcgguugauuaacguguucaccacuuccgccuacucuaaagaggcugaacguauccugcgcaagcagcaggaguuuaauaagaaaauaacagaugaguucauugagaacuaucuaaccauccucacgggaaagagaaaauacuaucacggcccagguaaugaaaagagcaggacugacuacgggcgguacaccacuaaaaaggacccggagggaaaauauauuacacuggauaacaucuuuggcauccuuauuggcaagugcaccuucuaccccgacgaguaucgagcauccaaggccucauacacagcucaagaauuuaaucuguugaacgaucucaacaaucugaccguaccuacggagacuaaaaaguuaagugaggaacagaaaaagacaauaaucaaauaugccaagaccgcgaagacucugggggcaagcacacuccuuaaauacauugccaagcugaucggagcuucuguugaccagauacaugguuaucgcauugauccaaacaaaaagcccgaaaugcacaccuucgagacguacagaaaaaugcaguccuuggagaccaucucaguggaagagaucccuaggaagguccuagacgaacuggcccacauucucacacugaauacugagcgggaaggcaucgaggaggcaauuaacgcuacccuuaaggauacauuuagccaagaccaggugcuggaauuggugcaguuccgcaaaaauaacaguucucucuucuccaagggguggcauaauuuuagccugaaauuaaugauggagcugauaccagaacuauacgagacuucggaggaacaaaugaccauccucacaagacugggaaagcagaaaucuaaggagaccuccaagaggacuaaauauauugaugaaaaggagcuuacggaagagaucuacaaccccgucguugccaaaucagugcgucaggcgaucaagauuauaaaugaggccaccaaaaaguauggcaucuucgacaacauuguaaucgaaauggcacgggagaauaacgaagaggaugcuaaaaaggguuacaaugaacgacagaaggccaacuuggacgagaaaaagagugcuauggagaaagccgcauuucaauauaaugggaagaaagaacugccugacaacguguuccacggccauaaggagcucgccacaaagauuagacuguggcaccagcagggagaaaaaugucuuuacacuggcaagaacaucccaauaagcgaucugauccagaaucaauauaaauacgagauugaccacaucuugccgcucucccugucuuuugaugacagcuuaucaaacaagguccuggugcuagcuaccgcgaaucaggaaaaagggcagaggacacccuuccaggcacucgauaguauggacgaugccugguccuaccgcgaguuuaagagcuauguuaaggaccugaaacuuuugucuaacaagaaaaaggauuaccugcucaccgaggaagacauuucaaaaaucgaggugaagcaaaaguucauagaacggaaucuggucgauacuagauauaguagcagggugguauuaaacgcucugcaggacuuuuacaaagagcaucaguucgauacaacgauuuccguugugcgcggacaguuuaccucucaacuucgacggaagugggguuuggagaaaucgcgugaaacuuaucaccaucacgccgucgacgcacucaucauugccgcuagcucccagcugagacuauggaagaaacagaauaacccucugaucucauacaaggagggccaauucguggaccaggaaacaggggagauaaucagucucucugaugacgaauauaaagagcuggucuuuaaggccccauacgaucauuucguggacacccuuaagagcaaaaaguucgaggauuccauuuuguuuucauaccagguugacagcaaauauaauaggaagaucucugaugcaacaauuuacgcgacucgcaaagcuaagcuggacaaggagaaaaaggaauauaccuacacguuaggaaaaaucaaggauauauaugcccucggcuccgaaaaacugaagaccgguuucuacaaguuucuucaccuguauaaaaaggacaaaagucaguucuugauguaccaaaaggaucggaaaacaugggacgaggugauugaaaagauccucgagcaguacagacccuuuaaggagaaagauaagaacgggaaagaaguagacuucaauccuuuugagaaguauaggaucgaaaacggcccaauucacaaauacagccgaaagggaaauggccccgucaucaagucucugaaauauuacgacaagaacauuccggaguccuucauaaauaucacuccuucaaacaguaaaaacaaggugauucuacgccagcugaaucccuggcggaccgauguuuauuuuaaccaucagacagaaaaauacgagcuccuggggcuuaaguaugcacacuugcaauucgagaaaaagacuggaaauuacagcaucaccauugacaaguacaacgaaaucaaagagaaggaaggugugucggagcaguccgaguuuaaauucacgcugcauaagaaugauuuacuccugauaaaagacacagaaaccaaggagcagcagcuuuuuagauuccugucuaggacuaagccaaacgucaaacacuauguggaacuaaagccuuacagccgugaugaguucgagaaaaaugaacgccucaucgagauucugggcucaguagacaagagugggcgguuugugaaaggauugggcaaguccaaccugucuaucuauaagguuagaacagaugucuuagguaaucaacacauuaucaaaaaggaaggggaggaacccaaacucaaguucuga

SEQ ID NO: 2840 - RNA, 3411 nt, Artificial Sequence
  Cas9 variant
augaacggccuggugcucgggcuugacaucggaauugccagcgucgguguuggcauacuggagaaggauaccgggaaaaucauucacgcuuccucuagauuguuccccgcagccacagcggacaauaacguggaaaggcggucaaaucgccagggacgacguuuaaacagaaggaagaaacaucggaguguacgccugcaagaucuauuugagggcuacggucuccugacugacuucagcaagguguccaugaaucuuaacccuuaucagcugagaguccaggggauggaaaaucaguugacgaacgaggaacucuuuguggcucugaaaaauaucguuaagaggcggggaauuucuuaccuggaugacgccucggaggauggcggcaccgugucaagcgacuaugggaaggcagucgaggaaaaccgcaaacucuuagccgagaagacaccaggacaaauccagcuggaacgauucgagaaauacggucagcuuagaggcgauuuuacuguggaggaaaauggggagaagcacagguugauaaacguauucaguaccuccgcuuaucggaaagaagcagagcguauccugcgcaagcagcaagaauuuaauucuaagauuacagacgaguucaucgaggauuaccuaauuauccucaccggaaaaagaaaguauuaccauggcccggguaacgaaaagagcaggacugacuacgggcgguuucgaacagauggaaccacgcuggacaauauauucggcauucuuaucggcaagugcacuuuuuauaccgaggaauaccgcgccuccaaggcuucauauacagcccaggaguucaaccuguugaacgaccucaauaaccugacuguucccaccgaaacaaagaaauuaagugaggagcagaagaagcugauuaucgaauacgcgaaaagcgcaaagacccucggggccucuacgcuucugaaauauaucgcuaagaugauugaugccuccguggaccagauaagaggauacagggucgaugugaauaacaaaccugagaugcacacuuuugaaguguaucggaagaugcaaucauuggagacaaucaaggucgaagaacuaccacgcaaaguucuggacgagcucgcacauauucugacccuuaauacugaaagagaggguaucgaagaggcuauaaacagcaagcugaaagauauuuucaauagggaccagguguuggagcucguacaguuccguaagaacaauaguucucuguuuuccaaaggcuggcacaacuucagcaucaaguuaaugauggaacugauccccgagcuauacgaaacaucggaggaacaaaugaccauucucacgcggcuggggaagcagcgaucuaaagagaccuccaagagaacaaaauacaucgaugagaaggaacuuacugaggaaauuuauaauccuguggucgccaaaucagugaggcaggcgauaaagaucauuaacgaggccaccaagaaauacggaaucuuugacaauaucguuauugaaauggcacgcgagaacaaugaggaagaugcuaagaaagacuauauaaagcggcagaaagccaaccaagaugagaagaacgcugccauggaaaaagcagccuuccaguacaauggcaagaaggaguugccagacaacaucuuucacggucauaaagaacugacaacuaagauuagacucuggcaccagcagggggagaaaugucuguauaccggcaagaauauccccauuagugaccuuauccauaaccaauacaaauaugagauagaucacauccugccuuugagccucuccuucgacgauucucugagcaauaagguguuaguccuggcuacagcgaaccaggaaaagggacagaggaccccauuucaggcacuagacucaauggaugacgccuggaguuaccgcgaguucaaauccuacgugaaggauagcaaacuccugucuaauaagaaaaaggacuaucuuuugacugaagaggauauuucaaagaucgagguaaaacaaaaguuuauugaacgaaaccugguugacacgcgguacaguagccgugugguccucaaugcucugcaggauuucuauaaaucccaccaguuagacacaaccaucucuguggucagaggccaguuuacuucgcaacugaggcgcaagugggggauagagaaaagccgggaaaccuaccaucaccaugccguggaugcacuuauuaucgccgcuuccucacaguugagacucuggaagaagcacaguaacccgcugauugccuauaaagagggacaguucguugacucugaaacaggugagaucgugagccuauccgacgaggaauacaaggagcugguauuuaaagcacccuaugaucauuucgucgacacccucaggucaaagaaauucgaagauagcauacuguuuucuuaccaaguggacuccaaguacaaucgaaaaaucagugaugcgacuauuuaugcuacacgcaaggccaaacuugacaaagagaagaaagaauacacguauaccuugggcaagaucaaagauauuuacgcacuggggacuaagacaccuagcaagaccggauucuauaaauuuuuagaccucuacaagacagauaaaucucaguuccugauguaucagaaggaccggaaaacuugggaugagguuaucgagaagauaauugaacaguacagaccauuuaaggaguacgacaaaaacggcaaggaaguggauuucaaucccuuugagaaauauaggaucgguaacgggccuauccguaaguacuccaaaaagggcaauggaccagaaauuaagucacuuaaauauuacgacauccuguugggcaagcacaaaaacauuacccccgacgggagucgcaacacggucgcccuccugagccuaaauccguggcggaccgauguguauuacaacucggagacaaagaaauaugaguuccugggacucaaguacgcugaccugugcuuugaagaggguggcgccuacgggauauccgaaguaaaguauaaaaagaucagagagaaagagggaauuggcaaaaauucugaguucaaauuuacucuuuacaagaacgauuugauccugauuaaagacaccgagacaaauugucaacaguucuuuagguucuggagccgaacugguaaggauaacccuaagucauucgaaaaacacaagaucgaguuaaaacccuaugaaaaggcaaaauuugagaagggggaggaacucaaggugcugggcaaaguuccaccuaguuccaaucaguuccagaagaacaugcaaauagagaaucuuucuaucuacaaagucaagaccgacauucugggaaacaaacauuuuaucaagaaggaaggcgaugagcccaaacuaaaguucaaaaaguga

SEQ ID NO: 2841 - RNA, 3420 nt, Artificial Sequence
  Cas9 variant
augagcgaccuggugcucggccuugauaucgggauuggauccgucgguguuggcauacugaacaaggugaccggggagaucauucacaaaaauucuagaaucuuccccgccgcucaggcagaaaacaauuuggagaggcggacaaaccgccaaggacgacguuuaacuagaaggaagaaacaucggcgcguaagacugaaucaccuauuugaagagucaggccucauuacggacuucaccaaggugaguaucaaccugaauccuuaccagcuuagggucaaaggucugacagccgaauugagcaacgaggagcucuuuauagcgcugaagaauauggugaagcaucgggggaucuccuaucuggaugacgcuucugaugacggaaacucgucaguuggcgauuacgcccagauugugaaagaaaauagcaagcagcucgagacuaaaaccccaggccaaauccaguuagaacgcuaucagaaguacgggcagcugcgaggagacuucacagucgaggaggaugguagaaaacacaggcuuauuaacguguuuccgaccagugcauaucaugccgaagcauugcggauccugcaaacucagcaggaguucaauccccagauaacagacgaauuuauuaacuccuaccuagagauccucaccggcaagcguaaguauuaccacgggccuggaaaugaaaaaucucgcacggauuacggcaaguauacuaccaaaaaggacgcucaaggucaguacauuacacugaacaacaucuucgggauccuuauuggaaaaugcacuuuuuauccagaggaguacagagccgcuaaggccagcuauaccgcgcaggaguucaaucuguugaacgaucucaauaaccugacaguacccaccgaaacgaaaaaguuauccgaggaacaaaaguaccagauaaucacuuauguuaaaaaugaaaaggcaaugggcccugccaaacuguuuaaguacauugcuaaacuccuuucaugugacguggccgacaucaagggcuacaggauagauaagagugacaaagcagagauucacacauucgaggcuuaucggaagaugaaaacccuggaaacuuuggaugucaagaaaauggcccgagaggaacuagacaagcuggcguacgugcucacacugaacaccgagcgcgaagggauccaggaggcccuugaucaugaguuugcagacggaacguucagccaggaacaaguggaugagcugguccaguucagaaaggcuaauucuuccaucuuugguaaaggcuggcacucauucagcguuaaguugaugauggaacucauuccagagcuguaugccaccagugaggaacagaugacaaucuuaacuaggcuggggaaacagaagaccacaucuuccagcaacaaaacuaaguacauugacgagaagcaacuaaccgaagagauauauaaucccgugguagcuaaaucggugcggcaggccaucaagauugucaacgcagccaucaaaaaguacggagauuuugacaauaucgugauugaaauggcucgcgagacaaacgaggaugacgaaaagaaggcgauacagaaaauccagaaggcaaauaaggccgagaaagacgcugccaugagaaaggcagccaaccaauauaauggcaaagcugaacucccucauucuguuuuccacggucacaagcagcuggccaccaaaauuaggcuuuggcaucagcagggggagcguugcuuguacacuggcaagacgaucuccauucacgaucugaucaacaacccaaaucaauuugaaauagaccauauccucccgcugucaauuacauucgaugacagucuugcaaacaaggugcuggucuacgcgaccgcuaaucaggagaaaggacagcggacucccuaucaagccuuggauagcauggacgaugcaugguccuuucgagagcucaaggccuucgugagagaaucuaaagcucugagcaacaagaaaaaggaguacuuacugaccgaagaggacaucucaaaguuugauguaaggaaaaaguucauugaacgcaaucuaguugacacacgguaugccaguagagugguccucaacgcacugcaggagcacuuuaggacccauaaaaucgauacuaagguguccgucgugcgcggccaguucacaagccagcuucgacggcacugggggauagagaaaacgcgugacaccuaccaccaucacgcuguugaugccuugauuaucgcggccucuucacaacugaaucucuggaagaagcagaaaaacacucuggugaguuauagcgaagaccaguuacuggacauugagacaggagaacuuaucuccgaugacgaguacaaggagucuguauuuaaagcuccuuaucagcauuucgucgauaccuugaagucgaaagaguucgaagacagcauacucuuuuccuaccaaguggauucaaaguucaauagaaaaaucagugacgcaacaauuuacgccacuaggaaggcuaagcuggauaaagaaaagaaagaguauaccuacacgcuagguaagaucaaagacauuuaugcccugggcaccaagacaccaucuaagacuggguuuuacaaauuccucgaucuguauaagaaagacaagagccaguuucuuauguaccagaaagaucgccggaccugggacgaaguuaucgagaagauauuggagcaguauagacccuucaaggaaaaagauaagaacggaaaagagguggacuuuaauccuuucgaaaaguacaggauugagaacggcccaauccgaaaauacucccgcaaggguaaugggcccgaaaucaagucacugaaauauuacgacaacuuacucggccgguuugucgauauuacaccgagcgagucuaagaauccuguggcacugcuuucccugaaccccuggagaacugacguauauuacaacaccgagacgaggaaauaugaguucuugggacucaaguacgcggaucuguguuuugaaaaaggcgggaguuauggaaucagcaaggugaaguacaauaaaauucgugaaaaggaggguauaggcaaaaacucugaguucaaguuuacacuauacaaaaaugaccugauccucauuaaggauaccgaaacuaaccgccaacagaucuuccgguucugguccagaacagggaaagacaauccaaagucauuugagaagcacaaacuggaacuuaagccuuaugagaaaaccagguucgaaaagggagaggaguugaaaguucugggcaaggugcccccaaguagcaaccgauuacagaagaauaugcaaauugaaaaccucucgaucuacaaaguccggacugaugugcuggguaaucagcacauaaucaagaacgagggggacaaacccaaacuugauuuuuga

SEQ ID NO: 2842 - RNA, 3420 nt, Artificial Sequence
  Cas9 variant
augaacuacuauaauggcuucaucauuaccgagaacgccauggcuagcaagcacgaaaaucugggggcacucacauuuggacuugacauagguaucgccuccgugggcugggcgguccugggggagaacagaauuaucgauuugggaguuaggugcuucgacaaagcugaaacugccaaggagggcgaaucuuuaaaucuggcacggcgcacggcccgacuacuccguagaaggcugcggcgcagagcuuggaggcuuaccaaacuggcacgguugcucaagcgcgagggucugauugccgauacaaacguguuucagaaacccuucaaucugaaggacgcuaacgagaaggggcucucauuuuggcaguuacgaguagaugcccuggacagaaaacuuagugcggaagagugggcaagggugaucuaccauuuguguaagcaccggggauuccauuggauaagccgugccgaagagaaagcugccgagggcgauuccaagucugaaggcgggaaagucaagcagggacuggcagguacuaagaaacuaaugcaggagaagaauuaucgcaccgcugccgaaauggugcucacagaguuuccugaagcgcagagaaacaaacaaggcgacuacucgaaggcccugucaaggauccuucugggggaugagaugacccaguuguucaaacaccagcgggagcucggaaauccacaugcaacugaaaagcuggaggcugccauuuuaggcaacggugaccacaaaagcgggcuguuuugggcucagaauccggcccucgcaggaaacgaucuucugaagauguugggccacugcacauucgaaaaggccgaguaucgaguucccaaagcuaguuuuaccgcggaacgccauguguggcuaacgagacugaauaaccucaggaucgucguggacggcacuacccggccucugaacgaggcagagcgccaccuugcccuguugaugccauaccaacaggcuggggaucucacauauaagcagcugagaacugccuuaaccaaagcaggauaccugcccgaauccuucagguacacaggucuagccuaugcuucuggccagaaggccgacgagaaagcaaaggacccugaaagcgcgccacucguaaagcugcccgcuuggcaugagcuucguaaaaccuuggaaaagaaagagcuggccuccgaguggcaaaagauuucaagugaugcacucgacgggaaaccucagcugcuugaucagaucgccuggguucugagcguguacaaggacgauacggaagucgaggcugaauuguguaagcucaaucugccaaacgccgagaaaaugauagacgcauuacuggauauucgguuugacaaguucucuaaucuaucccucaaagcucugcgacaaaucgugccgcuuauggagcagggacagagauaugaugaagccguggcgaacauucccgaguacggccaccacucacaguugcaugaagucggugccggggagcacaaguaucugccuccauucuacaaagaaagggacaagacuggccgcaugguuuuuaaugaugacauggacaucccccggaacccugugguacucagagcucugaaucaagcaaggaagguggucaacgccuuaaucaaagaguauggaagcccacaugaggugcacauugaaauggcucgcgaucugagucgaccccuugacgagcggcgugauguugaaaaguugcagaaagaguucagagacaggaaugaaaaggauaaagcccucuuugcacaggacuucaacauagugggcgcggucaaggggaaagaguuugagaaguaccagcuguaccgcgaacaacagggaaagugcgccuauucuaucgagccgauggauauucaucggcuauucgaacaggguuacguggagaucgaccacgcucugccuuauuccaggagcuuugaugacucgaaaaauaacaggguacucguucuggccaaggaaaaucgagauaaaggcaaccgcacacccuucgaguaccuugggggaaaggacaauucugagcgguggagacaguuuguggcauucgucgaaggcaacaaauccuauagguuggcuaagcguucacgccuguuacggaaggauuuugguaaagacgaggccaagggguucagagaaaggaaccucaaugacacccgauacauaugucgguuuuucaaaaacuauguggagcaauaccugcagcuucacgaggauagugacgcaaagcgcugcgucgugcugagcggccagaugacuuccuucuugagagccagguggggacucguuaaagugcggggcgauucugaccgacaucacgcucuggauggggcgauuguagccgcauguagccauucaauggucaagagacuaagugacuacucccgcaggaaggaacuggaacaggugcgugcuggauuuguugauguggacacaggugagaucgucaauccagccauguuccaacaggugcaggagcacuuuccuaaccccuggccacacuuccgggaugaaguaaaacucagacugaauguggacgaucccgcccuuuugcauagcgagaugaacagguuuggcaccuauucuccugaggcucugaaggcauuacgcccacucuucaucucacgagccccgcaaagacggaauaguggggcggcucacaaagacacgauuuacgcccagcccgaaaggcugguugcacagggaggcgucacccagaaggugccucuuacaagccugacucuaaaagaucucgacaagcugaucgacccacaucgcaacgagaaguuguauuccgccauucguauaagacuggaacaacacggugggaaaggcgauaaggcuuuucccgcaucuaauccuuuacggaaaccagacucggagggaaaccccaccggcccgaucgugagaggggucacaaugguuauugauaagcucagcggaaucccuauccgcggcgguauugccaaaaaugacuccauggugcgaguggauguauucacuaaggcggggaaauuucaucuggucccaguguacguucaccacgcuguggccaagguccuucccaacagagcagugguugccuauaaggacgaaaccgaguggacacugauagaugacggauucgauuuuugcuucucaauguacccuaaugacuugcuccggaucaaacugaggaacgcuagucaucuaggcuauuacgccucuuguaaucgcagcaccggugcaauuaaccuguggucccacgauagaaaccaacaggugggcaaggacgggaugaucgagucaauuggaguaaaaacugcucuuaaugucgaaaagcucaacaucgacgugcugggcaauagguaccccgccccaccugagaaacggcgugauuuggcguga

SEQ ID NO: 2843 - RNA, 3423 nt, Artificial Sequence
  Cas9 variant
augaagaacaugaccaaagugaaugucggccuggacguugggaucagcuccgccggauggucugugauuaacgcugagacaaaucagauacucgaaucagguguaagacuuuucaguggcagcgaugcagacgagaacgugaauaggcggaaccaacgccaggggcgacgucuguuuagaaggcggaaguugcgcauccaggaagccaaaaaguacuuagagaaugucuuccagcugaaagauauugaacccaaggacgaguggaacccuuaugagaucagagugagggcgcuaaaugaaaagguuuccaaagaggaacucucuauugcucugcuuaacaucgugaagcaccggggaauaucguacgagcuggaggaugucacugacgaagagggcacgaauacccaaucauuucagagcgguuuggauuauaaccgccgacuccugaaaacaaagacugugggggaaauccaguacgacagacugcagaaauauggacaaguaaggggccagauucagaccgaggauggccucuuaaucaauauuuucccaacaaagaacuacguugaagagguggagcggauccuggaaacccagaagaaauaucauccggagauagacgaugucuuuauugaaaagaucauuaguuucgugacucguaaacgcgaguacuuuguggggcccggaaaugaaaaguccagaacagacuacgguaucuauagggagaacggcgagacccuugauaacuuguucgaaauccugauugggaaagacaaguuuuacccugaggaauaucgggccgcaggaucuagcuacacggcccaaauauucaaucuacucaacgaccugaauaaccuucgaaucccaacuaccgaggaucaccaucugacaaaagcucagaaggaagagauuaucacugaguugaagaauaccucccgccucucaggcgguaugcugaaauuaauaaguaaggucacaaaagcacccaaggaagagauuagcggguauagaaaagacgaaaaggauaagccugaccugcacucucucgccuacuauaggaaacagaagaacaugcuugagaaagagggaauccaaaucgcugauuuuuccgaagaacuguuggacgaacuagccaccaugaugacgcugaauacugagccaggcgaaauucggaagcagcucaacaaaaucacaaaucaguacgauauucugacccccgagguuauagaggugcuuguaaagaaccauacugcguucguggcaacaucaaaucacaaguggcaccgcuuuagccugaaauugaugaaggaguucaucccugagcuccuggaaaccaguaaagagcagucuacgauuuuaugcgaaagaggcuucauccaaaacagggccuccuaccuggacgagaaucaucacuuuaacuaugcugagcuacgugaaaaucucuacaacccagucgugcggaagucuaccugugagaugcugaaaguuuucacagccauccaggaaaaguauccgaacauucagaaugugauagucgagcuuccccgagaaacuaacgaggaugagcagaagagaaaaaucaagaaaauuaaugacaacaaugcaaagaggaaaaaggaaaucuugaaagaggcucaagcccagucggggcugucugaagaggcgcucgaggaaaagcugcuuaagaccaaaggacuguacuugaagcucaugcugugguaugagcaggaagguaaaugcguguacuccggccaggagauuccuuuaucagaucugcuacaaaacaaagggggauaugaaguagaccauaucauaccaaucaguauuagcuuugacgaucgccucuguaauaagguucuggugcggcagcagcuuaacucccagaagucuaaucaaacacccuucgaguacaugacuacccacacagacggccacuugagcuuucaugagcugaaggaacucgucgguaaaaacaagagauucucaaaagagaagagggaacuguuacuggccgagaucuacaguaaugauauugaaacccgcaaacgauuuaucaaccggaaucuuguggacacuuccuauacggcacguauagucuugaacgcucuccagcaguacaagaaggagaaucaacugagcaugaacgugucuguugugagaggggccaugacaaacauucuaaggaaaaagguaaaacuggauaagacccgcgagacuuuccaccaucacgcuaucgacgccucacucauggcagucauuccuaauaucgaauuuuucaaagagcggaaggaauggcugccaaagagugccaacgaggaagugguugagguggaggucagcgaagaggaaaccaugcccgagaaagaguuuaaggugaaaaugagacuuccggaauccuucauacaggauguacagaucuugcagaggaauagcuuugcuaaggaggaagugucgggcccucaaacacgagagcgcaaccugaaaauuaaguucagccaucagguugaccagaaaaugaaucggaaggucgcggaugacaccaucuauggaacuagacaggcacaauuaggcaaggauaaaaaggaagagacauacgugauugggaaaaucaaggacauauauaacuacgaugaguaugugagguucaaaaagcguuacgacaagaauaaagaauccuuucucauguaccaccacgacccccagacguucgagaagcuggaagagauucuugcccaguauccagaauacaucgaggaugagaaaggaaagaaaaagaaggucucaccuuuugcucuguaucgcgaagagaacggucccguuaccaaauacgccaagaaaaauaacggcccagugaucaagcaguugaaauauuacgacaguaagcucaaucggaagauugauaucucucauaaauauagcacuaagaacagacaagugguacugcagucccuaaaacccuacaggacagacgucuaccgaaaucaggauaccggggaauauacacuggugggaauugaccaaaacgauggcaaguucguuaauggucacuacgggauaccuaaaucacgguaugaggaaaucaaggcaaacaacaagcucagcgagcaugacgaguuuguguucucucuguacaaaaauuccauggucaaggugauugaugaaaacggcgagaguaucguugugcgcuaucuuagcagaucuaugccaaauaggaaaaacaaugccgaaauuaagccgguagagaaauaccaguuugaggacggagaagucgugcccguguauggcaagugccggaaacagaugcagacugucuucguuaagaagggguggaccuugcugaaaggaaacacggauaucuuagguaauaccuacuuuguggagaaggaauccgagaacccuaaaaagaugauagacgauaaauga

SEQ ID NO: 2844 - RNA, 3423 nt, Artificial Sequence
  Cas9 variant
augagagagaacggcagcgacgaaaggcggcgcaauauggaugagaagauggacuaccgaaucgggcuggauauuggaauagccuccguggguugggcuguccuccagaacaauucugacgaugaacccguucguaucguggaccuuggcguaagaauuuucgauaccgcagagaucccuaaaacaggggaaucacuggccggaccaaggcgggcggcucgcacuacgagaaggcgguugcgccgaagaaagcacagguuagaccggauuaaauggcuguuugagaaccaaggccuaaucaauauagaugacuuccucaagcguuauaacauggccggucugccggauguguaccagcuucgcuaugaggcacuggacagaaaauugaccgaugaagaacucgcccagguccugcugcauaucgcuaagcacaggggguuucggaguacacgaaaggcagaaacugccgcuaaagagaauggagccgugcucaaggcgaccgacgagaaccagaaacgcaugcaagaaaagggcuacagaacaguuggcgagaugauuuauuuagacgaagcauucaggaccgggugcagcugguccgagaaaggauacauccugacuccccggaauaaggccgaaaacuaucagcauacaaugcuucgcgcuauguugguggaggaggucaaggaaaucuuuucuucgcagagaaggcuggguaaugagaaagccaccgaagaacuagaagagaaguaccucgagauuaugacgucacagcguagcuucgaucugggcccugggaugcaaccagacggaaaacccaguccuuacgcaauggaaggcuuuuccgaucggguggguaaguguacuuuccuuggggaccagggagagcugcgaggcgcuaaaggcaccuauacagccgaauacuuuguagcguugcagaagauaaaccacacuaaacucguuaaucaggauggggagaccagaaacuucacagaagaggagaggcgcgcccugaccuuacugcucuuuacgcaaaaggaagugaaguaugcagcuguccggaaaaagcugggacuuccagaggacauuuuguucuacaaucuaaacuauaaaaaggccgcuacuaaagaagaacagcagaaggagaaccaaaauacagaaaaggccaaauuuaucgguaugcccuacuaucaugauuacaagaaaugccuggaggaaagagugaaguaccucaccgagaacgaagugagggaccuguucgaugagauuggcaugauccuuacuuguuauaaaaaugacgauucucgcacagagcgacuggcaaaguuggggcucgucccuaucgaaauggagggacuguuagccuacaccccaacgaaguuccagcaccugagcaugaaagcuaugcggaacauuauaccguuucuagaaaagggcaugaccuaugacaaagcgugcgaggaagcagguuacgacuucaaggccgauuccaaagggacaaagcagaagcuccugacuggcgagaauguuaaccagaccaucaaugagauuacaaaccccgugguaaaacguucagugagucaaacugucaaggugaucaaugcuauaauuagaaccuauggaagcccucaggccaucaacaucgaacuugcaagggagaugucuaaaacauuugaggagcgccggaagauuaaaggcgacauggaaaagagacagaaaaauaacgaggauguuaagaagcagauccaagaguuggggaaacuguccccaaccggacaggacauucucaaguacaggcuguggcaggaacagcaagguauauguauguauucaggcaaaacuaucccccuugaggaacuguucaagccuggguacgauauugaccacaucuugccauacagcaucacguuugaugacaguuuccgaaauaaagugcucgucacaucucaggagaaccgccagaagggaaaucggacccccuaugaguacaugggcaacgaugaacagagauggaacgaguuugaaacuagggugaagaccacaauucgugacuauaaaaagcaacagaaacuguuaaagaaacauuucuccgaggaggagcgcagcgaguuuaaggaacggaaucugaccgauacuaaguacauaacaacgguaaucuauaacaugauuagacagaaucuagagauggccccgcucaacaggccugagaaaaagaaacaaguucgagcugugaauggugccaucaccgcauaccugcggaagcgcugggggcuuccccagaaaaacagagagacugacacacaccaugcgauggaugcugucgugauugccugcuguaccgacggcaugauccagaagauaucgagguauacaaagguccgggaacgaugcuacucuaaaggaacugaguucguggacgcagagaccggcgaaaucuuuagaccagaggauuacucccgcgccgaaugggacgagauuuucgggguucacaucccuaagcccugggaaacguuuagggcugaguuggaugugcguaugggagacgauccaaaagguuuccuggacacccacucagauguagcccucgagcuggacuaucccgaauacauuuaugagaauuuacggccuaucuucgucaguagaaugccaaaccauaaggugacaggcgcagcucacgccgauacuauaaggagcccgcgccauuuuaaagacgaagggauuguucugaccaagacagcgcuuacugauuugaaacucgacaaggauggagagaucgacggcuacuauaauccccaguccgaccugcuacuguacgaggcccucaagaaacaacugcuuuuguaugguaacgaugcuaagaaagcauucgcccaggacuuucacaagccuaaagcugaugggaccgaaggcccagugguccgaaaggugaagauucagaaaaagcagacgaugggaguauucguggacucuggcaaugggaucgccgagaacggaggcaugguuagaauagaugucuuucgggugaaugguaaauacuacuucgugcccgucuauacagcagacguugugaagaaagugcugccuaacagggcgagcaccgcccauaagccauacggggaauggaagguaauggaggauaaagacuuuuuauucucacucuauagucgcgaucugauccacauuaaguccaaaaaggacauccccauuaaaauggucaauggaggcauggaagguaucaaggagacuuacgcuuauuacauaggcgccgauauuagcgcagcuaacauccaagggaucgcccacgacucucguuauaaguuuagaggacuuggcauucagucacuggacguguuggagaaaugucagaucgauguucucgggcaugugagugucgugcggagcgaaaagaggaugggauucuccuga

SEQ ID NO: 2845 - RNA, 3423 nt, Artificial Sequence
  Cas9 variant
augaacggccuggugcucgggcuugacaucggaauugccagcgucgguguuggcauacuggagaaaaauuccgggaaaaucgugcacgcuucuucaagaauuuuccccgcagccaccgcggauaacaauguagaaaggcggaagaaccgccaggcucgacguuugaauagaaggaaaaagcaucggggagugcgcuuucaagacuuauucgaggauuacggccugcuaacagacuuuaguaaagucagcaucaaccucaauccuuauagacugaggguggauggucuuaaccagcagcugacuaaugaagaguuguucauugcccucaagaacaucguuaagcggcgcgggauauccuaccuggacgaugcaucugaagacggaggcacggugucgucagauuauggcaaagccgucgaggagaaucgaaagcugcucgcugaaaagaccccagggcagauccaauuagagagauuugaaaaguacggacagcugaggggugacuucacagugguagagaacggcgagaaaugccggcuuauuaauguuuuuagcacaagugcauauaagaaggaagccgagcguaucuugcgcaaacagcaggauuucaacaaucaaauuaccgacgaauuuaucgaggauuaccugaagauacuaacagggaaaagaaaguauuaccacggaccgggcaacgaaaaauccaggaccgacuacggucgguauacuacacauaaggacucuaaaggggaguacgugacccucgauaacauuuucggaguccugaucggcaaguguacguuuuaucccaaugaguaccgagcuagcaaggccuccuauacugcgcaggaguucaaccuucugaaugacuugaacaaucucaccgugccuacagagacuaaaaagcugucagaagaacagaaaaagaccauuaucgaauacgcaaaaagugccaagacauuaggcgcuagcacccugcucaaguauaucgccaaaaugauugauacgucuguggaccagauacgcggguacagagucgauguuaacaauaagccagagauccacacuuuugagguguacaggaaaaugcaaucccuugaaacaauuucaguaggagagcugagccggaacguguuggacgaacuagcacauauccugacccucaauacugagcgcgaagguauagaggaggcuauuaacacaaagcugaaagauaguuucucucaggaccagguccuugaacuggugcaauucagaaagaauaacuccagcuuguuuucgaagggcuggcacaauuucucucucaaacugaugauggaguuaauccccgaacuguaugagaccuccgaggaacagaugacgauccuaaccaggcucgggaagcagaaaucaaaggagacaaguaaacguacuaaguacauugaugaaaaggagcugaccgaagagaucuauaacccuguuguggccaaaagcguccggcaggcgauuaagauaaucaaugaggccacuaaaaagcacggaauuuuugacaacaucgugaucgaaauggcacgagagaacaaugaagaggaugcuaaaaaggacuacauuaaaagacaaaaggccaaccaggacgaaaaguaugcugccauggagaaagcagccuuccaguacaauggcaagaaagagcuuccagauaacauauuucauggucacaaggaauuggcuacuaaaaucaggcuguggcaucagcaaggggagaagugccucuauaccggcaaguccauucccaucucugaccugauucacaaucaguacaaauacgaaaucgaucacauacuuccucugagcuugucauucgacgauagucucuccaacaagguacugguuuuagcgacagcaaaucaggagaaaggacagcgcaccccauuucaagcccuggacagcauggaugacgcuuggucuuaucgggaguucaagucauacgugaaagaaaguaagcuacucggcaacaagaaaaaggaguaucugcuuacugaagaggauaucagcaaaauugaagucaagcagaaauuuaucgagagaaauuugguggacacgagguacuccucucgcgucgugcugaacgcccuccaggauuucuauaagaaucauaacuuugacacaaccauuucgguugugcgagggcaguucacuagccaacugcggcguaaguggggauuagagaaauccagagaaaccuaccaccaucacgcaguagaugcccugaucauagcugccucaagucagcuuagguuguggaagaaacagaauaacccgcucauugcauauaaggagggucaauuugucgacucucagacaggcgaaaucauuagccugaccgacgaugaguacaaagagcuaguguucaaggcgcccuacgaccauuucguugauacucuguccucaaaaacauuugaagacagcauccucuucucuuaucagguggauuccaaguuuaaucgcaagauaagugacgcuacgaucuacgccacccggaaagcaaagcuggauaaagagaagaaagaauauacuuacacacuugggaagauuaaggacaucuauagcuugggaaccaaaacaccuucuaagacuggcuucuacaaauuucuggauuuauauaacaaggacaaaucccaguuccucauguuucaaaaggauagaaagaccugggacgaggucauugagaaaaucauggaacaguacaggccauucaaggaauacgauaaagccgguaagcugguggacuuuaaccccuucgagaaauaucgacaggagaaugggccuauacgcaaguacucaaagaaaggcaacggaccagaaauuaagagucuuaaauauuacgacauccuguugggcaagcacaaaaauaucacgcccgaggggagccggaacaccguagcucuccugucgcuaaauccguggagaacagauguguauuacaacauggaaacuaagaaguaugaguuucugggacucaaauacgccgaccugccuuucgaagaggguggcgcauacgggauuuccaccgagacauauaaugaacuuagggagaaggaaggaaucggcaaaaacucugaguuuaaguucacuuuguacaaaaaugaucugauuuuaauaaaggacaccgagacgaacugucagcaauucuuucguuucuggagccgcacagguaaagauaaucccaagucauuugaaaagcacaaaaucgagcucaagccauaugaaaaagcuaaguucgagaaaggggaggaacuggagguucuuggcaaggucccucccaguuccaaccaguuucagaagaauaugcagauugaaaaccugucuaucuacaaagugaagaccgacgugcuaggaaauaaacauuucauuaagaaagagggcgauaagccaaagcucaaauuuuga

SEQ ID NO: 2846 - RNA, 3423 nt, Artificial Sequence
  Cas9 variant
augaacggccuggugcucgggcuugacaucggaauugccagcgucgguguuggcauacugaagaaagauaucggggagauuauccacaccaauuccagauuguucucugcugcaacagccgacucaaacauugaaaggcggggacaucgcggcgguaagcgauuaacucguaggaaaaagcacagaaguauccggcugcaugaucuauuugaggacuucgggcuccugacggauuuuagcaaaguguccauaaaucuuaaccccuaccagcugcgcguacaaggauuggacaaucagcucaccaacgaagaacuguucaucgcgcugaagaauauugugaagagaaggggcaucucuuaucucgaugacgcuucggaagauggcgggacagucucaagcgacuacggaaaagccguggaggagaaccggaaguuacuggcagaacagacuccuggucagauucaacuugaucgcuuugagaaauauggccagguucgaggggacuucaauguggucgaaaacggagagaagagaagguugaucaauguguuuaccacaagugccuacuccaaagaggcugaacggauacugcguaagcagcaggaguucaacaagaaaauuaccgaugaauuuaucgaggacuaucuaacuauucucacaggcaagcgcaaauacuaucacgguccagggaaugaaaagucuagaaccgacuacggaagguacacgacuaaaaaggauccggagggcaaauauaucacccuggacaacaucuucggcauucuuauagggaagugcacauuuuaccccgaugaguaucgggcaagcaaggccuccuacacugcucaagaguucaaucuguugaacgaccucaacaaucugaccguaccuacagagaccaaaaaguuaucagaagaacagaaaaagacgaucauuaaauaugccaagacugcgaagacacugggagcaaguacccuccuuaaauacaucgccaagcugauaggugcuagcguugaucagauucauggcuaucgaaucgacccaaacaaaaagcccgaaaugcacacuuuugagacauaccgcaaaaugcagucuuuggagaccaucuccguggaggagcuaccuagaaagguccuggaugaacucgcccacauucugacgcuuaauaccgagagggaagggaucgaggaggcaauuaacgcuacacugaaggacacuuucucacaagaucagguguuggaacucgugcaguuccggaaaaauaacagcagucuguuuucuaagggauggcauuccuucagcuuaaaacugaugauggagcuaauaccagaacucuacgagaccucggaggaacaaaugacaauccugacucgccuuggcaagcagaaaucuaaggagaccuccaagagaacaaaauauauugacgaaaaggaguugaccgaagagaucuacaaucccgucguugccaaaucagugaggcaggcgaucaagauuauaaacgaggccacuaaaaaguaugguaucuuugauaauauuguaaucgaaauggcacgugagaacaaugaagaggacgcuaaaaaggaauacauuaagcggcagaaagccaaccuggacgagaagaaugcugccauggagaaagcagccuuccaauauaacgggaagaaagaacucccugauaauguguuucacggccauaaggagcuggcuacgaagauccgacuuuggcaccagcagggagaaaaaugucuguacacaggcaagaacauaccaaucagugacuugauucagaaccaauauaaauacgagaucgaucacauucucccgcugagcuuauccuucgacgauucucugagcaauaagguccuagugcucgcgaccgcaaaccaggaaaaagggcagagaacucccuuucaggcccuggacucaauggaugacgcuuggaguuacagggaguucaaguccuauguuaaggauagcaaacuuuugggaaauaagaaaaaggaguaccugcucaccgaagaggacaucucuaaaauagaagugaagcaaaaguuuauugagcgcaaccuggucgauacacgguauucaaguagagugguauuaaaugcccugcaggacuucuacaaagagcaucaguuugauaccacuaucagcguugugaggggucaguucacaucccaacuucgccgaaaguggggcuuggaaaaaucucgggagacguaucaccaucacgcagucgacgcccucauuaucgcugccucgagccagcugcgucuauggaagaaacagaacaauccucugauauccuacaccgaagggcaauuuguggaccaggucacuggagagaucauuucacucagugaugacgaauauaaggagcugguguucaaagcaccauacgaucauuucguugacacacuuaagucuaagaaauuugaggauagcaucuuguucuccuaccagguggacucaaaguauaacagaaaaauuagcgaugcgaccaucuacgcuacaaggaaggccaaacuggacaaggaaaauaaggaguauacuuacaccuuaggcaaaauaaaggauauuuaugcacucgguacgaaaucucccuccaagaccggguuuuacaaauuccuggaccuuuauaacaaggauaagagucaguuucugauguuccaaaaagaccgcaagacaugggaugaaguaaucgagaaaaucauugaacaguaccggccuuuuaaggaguacgacgagaauggcaaagaagucgacuucaacccauuugagaaguauagaaucgaaaauggacccauuaggaaguacagcaaaaagggcaacgggccggagauaaaaucuuugaaguauuacgauaaucuccugggaaaauucguggacaucacuccuuccgaaucaaagaaccccguugcccuacugagucucaacccauggcgaaccgauguguauuacaauacagagacuagcaaguaugaguuucugggucuuaaauacgcugacuugugcuucgaaaagggcggggccuacggaauuucggaggucaaauauaacaagauccgcgaaaaagagggcauugguaaggaguccgaauuuaaauucacccuguacaagaaugauuuaauccucauaaaggacacggagacaaacugucagcagaucuuccgguuuuggucuagaaccgggaaagauaauccuaagagcuucgaaaaacacaagauugagcugaaacccuaugaaaaggcaagguuugagaagggcgaggaacuugaggugcugggaaaaguaccacccucaaguaaccaacuacagaagaauaugcagaucgaaaaccucuccauuuacaaagugaagacugacguucugggcaauaaacacuucaucaagaaggagggggaggaaccuaaauugaaguuuuga

SEQ ID NO: 2847 - RNA, 3423 nt, Artificial Sequence
  Cas9 variant
auggaggaaaacuuccaguacagaaucggccuggacauugggauaaccagcgugggaugggccguccuccaaaauaacucccaggaugagcccguuaggaucacagaccuuggugugcggauuuuugauguagcugaaaauccuaagaacggcgacgcacuggccgcgccacgccgagaugcucguacuacgagaaggcgguugcgcagaaggcggcaccgcuuagagcgaaucaaauuccugcuacaggaaaaugggcucauugagauggacucuuuuauggagagauauuacaagggaaaccugccggauguguaucagcuuagguacgaaggccuggaccggaaauugaaggaugaggaacucgcccaaguccugauccauauagcaaaacaccgugguuuccgcucaaccagaaaggccgagacaaaggggaaagagggaggcgcugugcugaaggcaacuaccgaaaaucagaaaaucaugcaggagaagggcuauaggacaguuggggaaaugcucuacuuagacgaggccuuucauaccgaaugccuguggaacgagaaaggauaugugcuuacuccccggaaucgaccugaugacuacaagcacacaauuuugcgcaguaugcuggucgaggaagugcaugcuaucuucgccgcgcagagagcacuagguaacgagaaggccaccgaggagcucgaaaaugcuuacguagagauuaugacgagccaaagguccuuugauaugggcccagggcugcagcccgacggaaaaccuucuccauaugccauggagggcuucggugaccggguugggaaguguacuuuugaaaaagaugaguaccgcgcacccaaggcuaccuauacagccgaacuuuucguggcgcugcagaaaaucaaccacacuaaguugauagacgaguuuggaaccggcagauucuuuacagaagaggagaggaaaaccauuaucgaucuccuguuaucgggcaaggaacugaaguacgggacgauucguaaaaagcucaauaucgacccuucacuuaaauucaacagccugaauuauagugccaagaaagagggagaaacugaggaggaacggguccgagauacagagaaggcaaaguucgcuuccauguuuuggaccuacgaauauucuaaaugcuugaaggacagaaacgaggaaaugacugugggucagaaagccgaucuacuggacaggaucggcgagauucucacagcuuacaagaacgaugacagccgcuccucacggcuggaggaucuugggcugaguagagaagagauagacggauugcucgaacugagcccagccaaauaccaaagggugucuuuaaaggcaaugcgcaagaugcagccguaucuggaggacggccuaaucuacgauaaagccugugaagcugcggguuaugacuuccgagcacucaaugaugggaacaagaaacaucugcuuaagggcgaggagauuaaugccaucgucaacgacauaaccaaucccguugugaaacgguccguaucacagacgauuaaggugaucaacgcuaucauucaaaaguacggaagcccucaggccgucaauaucgaauuggcacgugagaugaguaaaaacuuucaggauagaaccaaucuggaaaaggagaugaaaaagaggcagcaagaaaacgagcgcgccaaacagcagauuauagagcucggcaagcagaauccaacagggcaagacauccugaaauaucggcuuuggaacgaucagggagguuacugccuguauucuggcaagaagauucccuuggaagaacucuucgggggaggcuacgacaucgaucacauccugccuuacuccauuacuuuugacgauagcuauagaaauaaaguguuaguuaccgcucaggaaaacaggcagaaggguaaucgaacaccauacgaguauuucggggccgacgagaaacacugggaagauuacgaggcacgcgugcggcugcuagucagagacuauaagaaacaacagaagcuccugaagaaaaacuuuacugaagaggaaaggaaggaguucaaagagcguaaccuuaaugacaccaaguacauaacacgcgugguauauaacaugauccggcagaauuuggaacuggagcccuuuaaccauccggagaaaaagaagcagguuugggcggugaauggcgcugucaccucguaccucagaaaaagguggggacugaugcaaaaggaucgaucuacugaccggcaccacgccauggaugcaguggucauugccuguugcacggacggcaugauccauaaaauuucccgcuacaugcaggggagagaauuagcuuauucaaggaacuucaaguuuccugaugaagagacaggagagauccugaaucgggacaacuucacccgagaacagugggaugagaaauuuggugugaagguuccccuuccauggaauaguuucagagacgaauuggauauacgccuccugaacgaggacccuaagaauuuccuacugacucacgccgaugugcaaagggaacucgacuaccccggcuggauguauggggaggaggaaagcccaaucgaggaaggacguuacauuaacuauauccggccccuguuuguauccagaaugccuaaucauaaagucaccggcucugcacacgaugcuacaauuaggagcgcccgcgacuacgagacccgaggugugguuaucacuaaggugccacuuacagacuugaaacugaacaaggauaaugagauagaaggguauuacgacaaagauucagacagauuacucuaccaggcgcugguccggcagcuucuguugcauggcaacgauggaaagaaagccuucgcugaggacuuucacaagccgaaggcagauggcacggaagggcccgugguaaggaaagugaagauugagaaaaagcagaccaguggaguuaugguccgcggcgguacugggaucgccgcuaacggagaaauggugcguauugacguguucagagagaauggcaaauauuacuuugucccuguuuauacagccgauguggugcggaagguacucccaaacagggcagcgaugaaugguaagaucgccuccgacuggaaaaccauggaggauaacaauuucgucuuuagccuguacucucgcgaccuaauacacgugaagcgaaagaaagcuauccccacaauucugucaaguggcgccacuuucgaacaagaggaauuuuaugcauacuucaccggggcugacaucagcacgguuuccauugccggaaucucuaacgauaauucguuuaaauucagaggccucgggauacagggacuggagauuuuugaaaagugucagguggacauccuuggcaacaucagcgucgugcggcaugagaauaggcaggguuuccacuga

SEQ ID NO: 2848 - RNA, 3426 nt, Artificial Sequence
  Cas9 variant
auguacagcaucggccuggacauugggauagccuccgugggauauucugucaucgagaccaacucagguagaauuguugaacucggcgcuaggaucuucgaggcacggaauagugauaacaauaaggaccgccgagauuuucgugggggaagaaggcuuauucggcgcagaaaaacaaggcuggacgaugccaagcgguacuuggacgaucagggcuucaaaaacgacaagagcuuaaucaaugugugccccuauucccugcgcguaaaaggucuaacugaggaacucucuaagucggaaauacgaaaggugauccugcacauucuuaaaaagagaggggucucauaccugagcagugaggauuuggacacguccucuguggauaacaaagacagcuuuaagcaagcgguuaccaaaaaucucaggcagcuggaugacaagacaccuggacagauccaguaugagcggcugcaagaauccggccgugugcgcacuggcauuaaccagaaugggcaguaccagcucaacgucuucgacguggcuucauaugccaaggaguuaaaacugauccuugaaacccaacagcaguaccaucaggagauagaugaccacuuuuuggauuucuuuacaaaggacggauacagagaggaugcaggucugauuuauaggaaacggccauacuaugacggcccggggaaugccgcucaaaacaguagcuacggacgaugggcaaauuaucagguagauggcaagcccgccgaaaacaucuucgaccagcuaauugguaaagauuuuaccgggaagauccgcgcuucuaaucucggaccuuccgcccaaaaauucaaccugcuuaacgaccugaauaacuugagaaucacuacaagggaggaagagaagcucaccuuugaagagaagcaggagauucuggaaguuuuagagaaugaucggccaaaaacguucggcccccgcaacauagcgaagaugcugaaaguggacauggacgauaucaagggcuggagacucaauucaagcgacaaaccugaaauucauacuaugaaggaguacaacgauaugaggcuuguccuggaagcagggggauuugacaucaaggccauagauuuggaccacauugaggagaucgcuagucuaaucacccugaauacagaacgugaggccuucgaacucucucuguccaacgagauugauaauaaccuuaaacaguuccugguggaaaauuuuaacgcauugcggaaguguaaaccaaauaacagcuggcauucguucucuaaggagaaucuccagcgacugaucacugaguuagaacacaccuccgacgagcaaaacacaauucuggaaagacuaggucucaaauuugaucugaggucaaaguauagugaccgcgauacccuucccauacacgagguguuggaggaaaucuacaacccuacggucagcaaguccguucggcagacuuucagagugcugaaugcucucgugaaaaaguacggcaaagagaacauugacuauguaacaaucgaaaugccaagggauaagaaugaggacgaccagaaaaagaccauccgcgaaauucagaaggucaacaaaaaucgaaaggauaaaucuaaggaguacuuucugaaaaagagcggguggucagaggaaaaauucgaggaaaaacuucggacaagucguagauuugccuccaagcuguauuacuucuaugagcaagacggauugugcgcguacacuggccagcagauacagccggaagaucuccugaccgagaggguggagguugaccauaucauucccuuaagcgugucucuggaugacucaaucaacaauaaaguccuagugacgagugaagccaaccaaaagaaaggucagcgcagcccuuaugaugcauuuauguccggggacuucucuaaguaccggaccuacgaugaguauaaggcuuggguacucucgaauaaguacaagaaauauaagaaagcccugcuuuuggaagagagaaacauuuuugacccagaacuggcuaagaaauucaggcagcgaaaucucaacgauacacgcuacgccagccggaucguucugaaugcagugcaguccuuuuucuauaagacugacaccaagacaagagucgugaacggcgccuucacucacaccuuaaggaaaaaguggaaucuggcugauaaagaccgugagacacaucaccaccaugcgauagacgcaacccuugucgccgugacucccuuuguuaaggcugagcgcuacgaauauuacaaagauucagagggaaaggccaguaugguggacacgguaacaggcaccaucauuccuuacucugaauauaagaaaaagaacuuguacgaucggagcaacuaucuccugauguucgggaaugaguccacuaucaaccaagagaaagaagacaagucagcagaguuuauuagaaaucuaaucccagccaaaauauaccccgaaauuaaguucagccaccaggucgauaggaaaucuaaccgacggcuguccgacgcuaccaucuauaguacacgcagcuacaccguggagaagggaagagguaagaauaaaagggaaguuauugagcgggauaucauaggcaagaucaaagacauuuauacugccgauggguacgcagaguacgugaaguauaaagacucucuccuggucaaggaaaucgaugagaagacauuugaaaaacuugaggcgauuaucgaagaguucuccgacacgguggagguaaccgaccagcaaggaaaggugaaaaagguuucaaaaaguccguuuuugcaguacugugaaaaguaugaugucccuggcgugacuaaguacagcaaaaagaacaauggucccgugauacgaucgcugaaauauagauacacaaaguuacgcucccauauugacaucucuccuaaaaacagcaagaauaccgucgcucuccugacacuugccccauggaggacugauguuuauuacucacaggagaccgcaaguuaccaccuguuggggcucaaguauaucgaccuguccuuccgugauggcggauacggcgugucucggaaaagauaugaagagauuaagaaaaacgaaaggauccccgaggacggggaguuuaaguucagccuauacaaaaaggauuauauugaaauagaguuugacaagaaaauccugccaggacucuaccagucccgcgaugugucagcccgaaauaaguucagcaugaaacccauugacaaggcucaauggacgaguaaagaagauguacugauguuugguaacgucaaggccucuggcguguucgagaaaacccuuaagaagaauuauguuuugagaaaauaccauguggacguccuggggaacaaguucgaggugaaagaugaaaucuuaaaggacauucucgaguga

SEQ ID NO: 2849 - RNA, 3429 nt, Artificial Sequence
  Cas9 variant
auguacagcgugggccuggacaucgggauugccuccugcggauauucuauaaucaacgaugucaaugguaacauuguugagcucggcacccuucuguucaagucaagaaauagugacaacaaugaagagaggcggacaaaccgcgggagccgacguuugaucaauagaaggcggacucgcuuagaugacggaaagaagcugcuagcugaaaaaggcuuuaagcaggauuccaaacucaagcacgugugucccuacgagcugagaguaaagggucuucaugaaaaacugacgcaaggggagauuuauaagguggucuugcacauccucaaaaagaggggaauaucuuaccuggacgagucggaugaaaacucaagcggcaucgacggcgcaaguuauaaagaucaggugaaucugaaccucaauuuacagaaggagcugaccccugggcagauucaacuuaagcgguugaaagaaaacggacgcaucaaguccgguguuacauucgagaauggcuaccagcugaacguguuuucugucagcgccuaugcgaaugagcuaaacaaaauucucacuaagcaguccgaauacuacucagagaucgaccagauauggauugaucgauucaccaaaaacggguauagaaaggaagcuggacugguguacaggaaacggccauauuacgacggcccggguaaugagaagaacaauaguaucuaugggcguugggccaacuuuaaggaagauggacaucccaaagagaauauuuucgaccaacuuaucggccuggacagcguagauucuacacagguucgcgcauccgccucaaccuugacugcucagaaguacaaccuccugaaugacuuaaacaaucugacaaucauugaggaugacagaaaauuuaccacggaugaaaaggugagcauaaucaacuaucucaugacucaggacauuaccagguucggcccuaaagagcuugcaaaguuuuaccaacuggaagucgaucagauccggggguggcgaauagacaauaagggaaacccagagauucacaguuugaaaguguaccgcgauuggaagaaaaucuucaauacaucuuccaucgaccuaacuagcauucagaccuggguggucgaugaacuggccaacguuaucacacucaauaccgagauucccucgacgcuggcuacucuuaagauaaaaaucccugacauugaccaacagauccugaacuuuguggagaacaauuucuaugaauugaagaagaaaacaucuaagaacuccuggcauucauuuagucucaaaacccugaauaucuuaauuccagagcugcuaaacacuagcgaagaacagaauacaauacucgaaagacugaaccuuaaguucgauuugaaaaauaaguacgccgagaagaaccagauccccguaaaagagcugcucgaacaaauuuauaauccuaccgugacgaaguccguccaccagucuaucaaacuguucaacgagauuaucgaaaaguacgguaaaaauaacauaagcuaugugaccaucgagaugccaagggacaagaaugaucaggaccagaaagauacaauuaagcggaucaacaaacuuaauucagagcgcaaaaacgacagugaaaaguacuuucuggagagauccggcugggauacuauuagguucgaaagcgcguugaaaaagccgcguuuugcagagaaacuccuguucuauuacgaacaaaaggggaagugcgccuacucuggacaggacaucuuagcugagucacugcuaaacgagaguugugaaguugaucacauaauuccccucagcaucuccuuugacgauucuauucauaauaaagugcuggucaccgccucgagcaaccaggagaagggccagcggacaccuuauauggcauucaucgacggugcuaaacuugggcaauccugggaugacuuuguggccuggguaaauucaugcggcuuccaccgaaagaaaguucagaacuugcuguacgaagagaauauauuuaacccagacgugcagagaggauucgucaguaggaaucucaacgauacucgcuaugcgucucggaucgugcugaaugccauucagagcuuuuucuacaagcaaaaggacuuaaccaaagucaaggugguuaacggcuccuuuacacauacccugaggaaaaagugggggucaagccuugauaaaaauagagacacuuaucaccaccaugcaguggaugcuacguugugugccguaacacccuucaucaacauugucaaguacgaguucuuugaggaggacggaaucaaguauaugguggaucucaccacuggugaaaaaguugcuuacucugacuacaagaaaaugaaguucuaugauaaacgcgccuacgugccuauaugggacggcuuuauuaagcagcugaccccagcaaaucuauaucccaaaaucaaguucucccaccaggucgauaguaaguggaaccgaaaaaucagcgacgccacaauuuacucuacccggaagaucguggagacuaaaauuaauaagaaagggguagcuaaggaaacagugaaggauauaguuaucgacaaaauuaaggacaucuauacgccggagggauggcguaaauuuaaggaaaaacaagauaagcugcucaugaagaacuucgacgagaaaaccuacaacaagcugauuaaaaucgcgaaggaguauccugagaaaaaggaaguccagacuuccaauggcaaggugucacuuguggaagucagucccuuuaaaauguacugcgaggagcagaacguuccagcaauaagaaaguacagcaaaaaggguaaugggccuuauaucaggucguugaaauucuacgauaaggaacugggcaagcauauuaacaucacaaaagacuccuauggaaaugauauugagcgcaccauccggaacaagaaaauaauuuuaaagaaucagaacucuuggagaacagacguguacuauaauagcgugaacaauuguuacgaacuccugggcaucaaauauugccaccuuaaguuuuacagggggaaauacggaauccccaagucaauuuaugaugagcugaagaaagaagacgagauaaguuccgagucuguauucaaguuuagcuuguaccgacaugaucgcguccgguucgaaaaagacggugaguauaucgaagcccucuuuggcuccaagaacgagucaaauaaaaacuaccuggaacuaagcccaauugauaagaauaaguggcugaguaaagagaacgugaaguucuucggggagguugcugccucuggaagauuuaucaaaggccucaagcccgguauuaaagugaucaagcaauccacugacuauauggggcacgucuacgcaauacaccaggaaaagcugaaauucgugcuuagcgacgccuga

SEQ ID NO: 2850 - RNA, 3435 nt, Artificial Sequence
  Cas9 variant
augaccagcaagcaggagaaacacggcgcccugacauucgggcucgacaucggaauugcuuccguggguugggcaguccuuggcgaaucuagaauaguugaucugggggugaggugcuuugacaaggccgagacugcgaaagaaggagagucauugaacuuaacgcggcgcauggcucgacugcuacguagaaggcuccggcgcagagccuggaggcugaccaaacuugcacggcuguugaaacgcgaaggccucaucgccgaugcuaaucuguucaagcauaagauugagaaaaacacacccguaccuaagaguagcuggcaacugcgaguggacggucucgauagacaguuaaaugcagaggaaugggccagggucaucuaccaccuguguaaacaucggggguuucacuggauuucccgugcugaggaaaaggccgcggagggagacucuaaaggcgagggcgggaaggugaagcagggacuugcagguacuaaaaaguugaugcaggaaaaaucguaucgcaccgccgcugagaugguucuggccgaguucccagaugcacaaagaaacaagcagggcgacuacucaaaagcucuaagcaggauccuccugggggaugagcuuaaggcccuguuugaacaucagcggaaauugggaaauccgguggcgacagagaagcucgaggccgcaauacugggcaacggugacaagaaaugcggguuauucugggcucagaaucccgcccuggcuggaaacaagcuccuugaaaugcugggccgauguaccuuugagaaaacuggcggggaugacggaaagggugaauaucgcgccccuaaagcaaguuucuccgccgagagacacgucugguugacacaccuaaauaaccugaggaucgugguagauggcaccacgcggccacucaaugaagcugagcgcagaguugcgcugcccaugccuuaccaacaggcaggggaccuuucuuauaagcagcugggaggcgccuugauuaaggaggguuuucuccagaaagacggguucaaguuugcuggccugccauaccccacuaaacaagccagcgaagagaaggcaaaagauccugaaaccuccguguuaugcaagcugccagccuggcauacacuaaggaagacucucgagaaacacggacuggaaucagaguggcagaaacuuaguaccgacgcuuuggauggcaagccgcagcugcucgacaacaucgccuggguccugagcguguauaaggaugacgaugaggugaaaacagaacuugggaagcugaauuugcccaacaccgagaagaugauugacgcacuccuggauauccguuucgacaaauuuucuaauuuaucccugaaggcgcuaucaaaaauagucccuuucauggaacaaggacagcgguacgaugaggcuguugccaacauuccagaguacggucaucacagccagcuccacaaggugggcgcaggggaacauaaauaucugcccccuuucuacaaggagcgagacaaaacgggaagaaugguauuuaacgacgauauggacaucccaaggaaucccgugguccuucgcgccuugaaccaggcucggaaggugguuaaugcccugauuaaggaauauggcaguccgcacgaggugcauaucgaaauggcaagagaucucucuaggccucuggacgagcgccgagauaucgagaaauuacaaaaggaguucggugaacggaacaaaaaggacaaagaacuguuugcucaggauuucaauauugucgggacugugaagggcaagcaguuugagaaauaccagcuuuaucgugaacaacagggaaaguguauauaccccuccauggacgagaaacagggcaucugcuguuauagcuugaagccacucgaucugcacagaguacuauacgaggaaggguacgccgagauugaccaugcgcugccuuauucgaggucuuucgaugacuccaaaaacaaucgcguucucgugcuggccaaggaaaaccgggauaagggaaauagaacacccuuugaguaccuuggugacaaagacaacucagaaccauggaggcaguucgucgcuuuuguggagggcaauaaggcauaucgauuggccaaacgcagucggcuguuaagaaaggauuucggggacaaagaggcuaaggaauuuagggagcguaaccucaaugauacccgcuacaucugcaaguucuuuaaaaacuaugucgaacaauaccugcagcuucacgaggacagcgaggccaagcggugugugguucuguccggacagaugacuucuuucuugagagcaagguggggccucgugaaaguacgaggugauagcgaccggcaccaugcgcuggaugccgcugucguggccgcaugcucacacgggaugguuaagcgccuaagugacuauuccagaaggaaagaacuggaacaggugcgggaaggcuucgucgauguggacacaggagagauaguaaaucccgcuauguuucaacaggugcaggaacauuucccuaacccauggccgcacuuucgagaugagguuaagcucagacugagcauugacgaucccacccuuuugcgcucugagauggaaaaauucggcacguacaccccugagucacuggaagccuuaaggccacucuuugucagucgugcaccccaacggagaaacagcggggccgcucacaaggacacaaucuacgcgcagccuaagaggcugguggcccagggaggcgugacucagaaagucgcacuuuccucucugacccuaaaggaccucgauaaacugaucgacccacaucgcaaugagcgauuguaugcugccauuagagcccggcuggaacaacacggugggaagggagauaaggcuuuccccgcaucgaacccguuaaggaagccugacagcgagggcaauccaacaggucccaucguucgcggcgugacuauggugauugauaagcucuccgggauaccuauccguggaggcauugccaaaaacgacucaaugguaagagucgauguguuuaccaaggcgaauaaauuccaucugguucccguguacguccaccauagugugcuugggcugccaaaccaggcuaucguuggaggcaaggaggaaucugaguggacacagaucgacgauagcuuugacuggcacuucuccauuuauccuaaugauuugauacgggugacccucaaacaggaagguagguuuggguacuaugccggaugugaccgcucaacugcagccauccaccugugggcucaugaccgaaaccaacagguaggcaaggauggucuaauuagaagcaucggcgucaagacggcacugucuauugagaaauucaauguggacgugcuugggaaccgguaccccgccccaccggaaaagaggcgcgaucucgcguga

SEQ ID NO: 2851 - RNA, 3435 nt, Artificial Sequence
  Cas9 variant
augaccagcaagcaggaaaaccugggcgcccucacauucgggcuugacaucggaauugcuuccguggguugggcaguccugggcgaaaauagaauaaucgauuuggggguuaggugcuuugacaaagccgagacugcgaaggaaggagagucuuuaaaccugacgcggcgcauggcucgacuacuccguagaaggcugcggcgcagagccuggaggcuuaccaaacuggcacgguugcucaagcgcgaaggccugauugccgaugcuaaucuguucaaacacaagaucgagaagaacacacccgugccuaaaucaaguuggcaacuccgaguagacgguuuagauagacagcugaaugcagaggaaugggccagggugauuuaccaucuuuguaagcaccggggguuucauuggaucagccgugcugaggaaaaagccgcggagggagacuccaagggcgagggcgggaaagucaagcagggauuggcagguacuaagaaacugaugcaggaaaagucuuaucgcaccgccgcugagauggugcuagccgaguucccagaugcacaaagaaacaaacagggcgacuacucgaaggcucucucaaggauacugcuuggggaugaacugaaagccuuguuugaacaccagcggaagcucggaaauccgguugcgacagagaaacuggaggccgcaaucuuaggcaacggugacaagaagugcgggcuguucugggcucagaaucccgcccucgcuggaaacaaacuucuggaaauguugggccgauguaccuuugagaagacuggcggggaugacggaaaaggugaauaucgcgccccuaaggccagcuucagugcagagagacauguguggcuaacacaccugaauaaccucaggauugucguggauggcaccacgcggccacugaaugaagcugagcgcagaguagcgcuucccaugccuuaccaacaggcaggggaccuguccuauaaacaguugggaggcgcccucaucaaggaggguuuucugcagaaggacggguucaaauuugcuggcuuaccauaccccacuaagcaagccucugaagagaaagcaaaggauccugaaaccagcguucugugcaaacuaccagccuggcacacacucaggaagacucuggagaagcauggacuugaauccgaguggcagaaauugucaaccgacgcucuggauggcaagccgcagcuccuggacaacauugccugggugcuuagugucuauaaagaugacgaugaggugaagacagaacuggggaaauugaaucuccccaacaccgagaagaugaucgacgcacuguuagauauacguuucgacaaguuuagcaaccugucucuaaaagcgcucuccaagauugugccuuucauggaacaaggacagcgguacgaugaggcugucgccaauaucccagaguacggucaccauucacagcugcacaaaguuggcgcaggggaacacaaguaucuucccccuuucuacaaagagcgagacaagacgggaagaaugguguuuaacgacgauauggacauuccaaggaaucccguaguguugcgcgcccugaaccaggcucggaaagucgugaaugcccucaucaaggaauauggcagcccgcaugagguucacaucgaaauggcaagagaucugaguaggccuuuagacgagcgccgagauauugagaagcugcaaaaagaguucggugaacggaacaagaaagacaaggaacuuuuugcucaggauuucaauauaguggggacugucaaaggcaagcaguuugagaaguaccaguuguaucgugaacaacagggaaaauguaucuaccccucuauggacgagaagcagggcauuugcuguuauucccucaaaccacuggaucuacauagagugcuguacgaggaaggguacgccgagaucgaccacgcgcucccuuauagcaggucguucgaugacucuaagaacaaucgcguacugguucuugccaaagaaaaccgggauaagggaaauagaacacccuuugaguacuugggugacaaggacaacuccgaaccauggaggcaguucguggcuuuugucgagggcaauaaagcauaucgacuggccaagcgcucacgguuacucagaaaagauuucggggacaaggaggcuaaagaauuuagggagcguaaccugaaugauacccgcuacauaugcaaguucuuuaagaacuauguggaacaauaccuucagcugcaugaggacagugaggccaaacggugugucguguugagcggacagaugacuuccuuccucagagcaagguggggccugguuaaggugcgaggugauucugaccggcaccacgcgcuagaugccgcuguagucgccgcaugcagccaugggauggugaaacgccugucagacuauaguagaaggaaggaacucgagcagguucgggaaggcuucguggaugucgacacaggagagauugugaaccccgcuauguuucaacagguacaggaacacuucccuaauccauggccgcauuuucgagaugaggugaaacugagacuuuccaucgacgaucccaccuugcugcgcagcgagauggaaaaguucggcacguacaccccugagucuuuagaagcccucaggccacuguuuguuucacgugcaccccaacggagaaacaguggggccgcucacaaagacacaaucuacgcgcagccuaagaggcuugucgcccagggaggcgugacucagaagguggcacugagcucccuaacccucaaagaccuggauaaguugauugacccacaccgcaaugagcgacuguaugcugccaucagagcccgguuagaacaacauggugggaaaggagauaaggcuuuccccgcaucuaacccgcucaggaaaccugacucggagggcaauccaacaggucccauuguccgcggcguuacuauggugauagauaagcugagcgggaucccuauucguggaggcaucgccaagaacgacuccauggugagaguagaugucuuuaccaaagcgaauaaguuccaccuugugcccguuuacgugcaucacucaguccugggguugccaaaccaggcuaucgugggaggcaaagaggaaagugaguggacacagauugacgauucuuuugacuggcauuucagcauauauccuaaugaucucauccggguuacccugaagcaggaagguagguuuggguacuaugccggaugugaccgcuccacugcagccauucaccuaugggcucacgaccgaaaccaacaggugggcaaagauggucugaucagaucaauuggcguaaagacggcacuuagcaucgagaaguucaaugucgacgugcucgggaaccgguaccccgccccaccggagaaaaggcgcgaucuggcguga

SEQ ID NO: 2852 - RNA, 3438 nt, Artificial Sequence
  Cas9 variant
augaagaccauccugggccucgaccuugggacaaacagcauuggaugggcccuggugaaagagacugaaaauuccaacgagaagucugaaauaaucaaauugggugucagaguuaaucccuuaacgguggaugagaagaccaacuucgaagcuggcaggccucugucaacaaaugcagaccggacugccaaacgcagugcgcgacguaaccuacagagauacaagcucaggcggaagaaucugauugaucuucugaucaaacaccgcuugauugacaaggauaccccacucacagagaucgggaaaaacaccacucaucaaacacuggagcugagagcuaaggccgcaagggaacggauagagcucgaagacuuagcccgcguauuucuggcuaucaauaaaaagcgaggauauagaagcuccaggaaggugaacaaugaggaggaaggccaggucguggaugguauggcaguugccaaaaaguuguacgacgagaaccuuaccccggggcaguaugcuuacgaacugcuaucuaaaggaaagaaauaugugcccgauuucuaccggucggaccuccaggccgaguuugauucaauuugggaauaucaaaagcaguucuacgcggacauccuggaugacgagcuuuacaaugcacugaaaggccagggccagcaaaacagccguaagcgcuuuuuggccauuaagggggucuauacggcugagaauaaaggaaagagagacgaagugaaacuccagcacuacaaguggaggagugaggccaucacucagaaacuguccauagaagagguagcauauguuuuaguggaaauuaacaacgaucugaauaagucuagcgguuaccucggcgcuaucuccgaccggucaaaggagcuuuauuucaacaaagagaccgucggggaaaaucuguggaagcagauucaaaagaacccucauacaaguuugaagaaucagguguuuuaccgacaggauuaucuagacgaguucgaacaaaucugggagacucaggcccaguuucacccacagcugacccucgcgcugaaagaacaaauccgcgauguggucauuuucuaccagagaaaacuuaagagccagaaaggacuguugucuuuuugccaguucgaguccugggagauagaaaggaaggacgagaacggcaauguuauccucaacaaaacaacccaacugcccaagcggcagacggugggucgcagaguagccccuaaaucaagcccauuauuucaggaguucaagauuuggcagaauaucaacaaucuggagauagcaaagauuagugaugggaacucuaaaaauaagaaagagacugaagcucuauccgacgaugagaggaagcuccuguucgaagaacuuaacuugcguggaaaucugagccaaaaagaagugcuccagauccugggccuuaaggacaaagaguacaagacaaacuuucccgagggccuggaagggaaccggaccaaugccgcuuuguucaacaucuaucagcagauugccgagaaugaaggauacggugauuggacuaagaaaucggcacaagagaucaaggaggaacucaaagccgucuuuccucagauuggcauacaggcugacauccuggacuucaacgcggaguuagaugggaaggaauuugagaaucaagcaucuuaucagcuguggcaucuacucuacuccgccgaagaggacgauaaaauuaacgaagaggaccagaucaucuauggaaauucagcugugagucugaagaagaaacuuugugagaaguucggcuuuacaccagaauacgccaaauggauugcaaacguuagcuugcaggaugacuaugguaaucuguccaccaaggccaugcgaaaaauaaucccguaccucauugaugggaacgacuacucugaggcuugcgcccuggcaggcuauaaucacagcaacucauuaacgaaggaagagaaugauaacagagagaggcugaauaaacuugaauugcuccccaaaaacagucugcgcaacccuguggucgagaagauccuaaaucaaauggugaacguaguuaaucaggugauugaaaccuacggaaaaccagacgagguccggaucgaacuggcgagagagcucaagaaauccgcugaggaaagggccgagaugacaaagggcauaaacgaagcaacucgccgaaaugaggauaucaagaaacugauuaccaagaacuucgggauccccaauccuacaaagaacgacgugguccgguaucgucuuugggaagaguuggccccacuggcuuacaaggauguguuuacuggaagacagauuaaaaaggaggacuuauucagcucuaaaaucgacauagaacacauuauccccaaggcccuccuguuugaugacucauucaguaauaagacccuugcauuuagggagacaaaccugaaaaaggcugaucgcaccgccuaugguuucauugaaagcgacuacaaugcgacuuuggaugacuauauccagcggguugagacgcucuacaacaaugccaaaggcacaauauccaaggggaaaagaaacaagcugcuaauggcucaaaagaaucugccggauggauucaucgaaagggaccuccgaaacucucaguacauugccaaaaaggcaaaaucgaugaucgagaagguguuuaacgauguaaaugucaccagcggcuccauuacugaccgccugcgggaggauugggaccuuaucaacgugaugaaagaauugaauuucccuaaguauaaggcucuggguuuaaccgagauagaagagagauacgauauugggcaggagaaaacaaagaaaguugaagugaucaccgacuggacuaagaggaacgaccaucgucaccaugccauggaugcacucacagucgcguuuacgaccaaaucacacgugcaguaucugaauaaccuuaauacuauccacagucugaagggcgacgagguagaucuagaacucucuaagcuguacggauugaaaaacacaauuaccgaggugguuaauaagaaacgcaaguucauucccccaaugccuaacuuucgggaagaggccaaaaagcauaucgagacaauacuggucagcaucaagaauaaaaacaagguguauacuaaaaauauuaacaagaccaaaaaggaauccggcuaccacacgaaagagcaauuaacccccagagggcagcuccauaaggaaacaguguauggaaagucaaaaaggccaaugaauaagcccacuaaaaucaacaagaauuucagccuggagcaggcucaacuuauuaucaacguccaggaaaaagagcugguuuugcgacaccucgcccaguuugacaacaauccugcaguggcuuucgauaccaagacacugaagaaaugucauuaccuaaagauggugaaccuguga

SEQ ID NO: 2853 - RNA, 3441 nt, Artificial Sequence
  Cas9 variant
augagcggcaacacccacgggccccugacauucggauuugacaucgguauugccuccgugggcuggugcguccucggggagaauagaauaguuaaccuuggagugagguguuucgauaaggcugaaacugcaaaagagggcgaaucucugaauuuggcccggcgcacggcgcgauuaaugcguagaaggcugcggcgcagagcuuggaggcuaaccaagcucgcccggcugcuuaaacgcgagggucugaucgcagaagccucacgaauccauauuccuaguccaguaagcccguggagauugaggguggaggggauugaccggcgucucacagaugacgagugggcucgcgucaucuaccaccugugcaagcauagaggauuucacuggauauccagggcagaagaacggaaagccgaaucugaugcuaaggagggcggccgagugaagaaagggcugucggacacucagcgcagaaugaccgagaagggauauaggucagccgcggaaaugguucucgcagaguuccccgaugcccaacggaacaaacagggugacuacggcaaggcuuuaagccgcauccugcuuagugaugaauuggcccugcuauuuagaaggcagcgugagcucgggaauccuaacgcaggaaaugaacuggaggcuacaauucuuggcaacgguaaucggaaauccgggcuguucugggagcagaagccacccuuggccggagcggaccuccugaagauguuaggccgauguaccuuugagaaaaacgaguauagagccccuaaggcaucuuucacugcugaaaggcauguguggcugacacgccucaauaaccuucgggucgugguagauggcaccacgagaagccuggacgaugccgagcacagguugguucuaccacugcccuacaaacaagcuggggacuuuacuuauaagcagcuccgcaccgcccugacaaaagcaggacuucugccugaagguuucaaguuugccggcuuguccuacccaacugggcgacagcucgacgauccgaaagcuaaggaccccgagucagagaagcuggugcgguuaccugcguggcaggaacugcguaaaacccuaaaggauaaaaaucucgagacagaaugggagggaauggcaggcgccgcuaccggugggaacccagaacugcuugacgagaucgccagagucuugaguguguucaaggauggcgacgaggugacggcagaacuguggaaacucccccugccuggaggcaaggccaugauugaugcucuuagcgagaucucuuuugacaaguuccacgcccuguccuugaaagcacucaggaagauagucccacauauggaaucagggcugcgcuaugaugaggcgugcgcuguugccggauaccaccauagccaauuacacgcagccggugcuggcgagcacaaauuccugcccccguuuuacagucggagagacaaggaugggaggaugguguucaaugaggaacuagacguaccucgaaaccccgugguccuccgcgcccugaaccaggcacggaaagugcuuaaugcuuugguuagaacuuauggaucuccaacagccgugcauauugaaauggcgagggaccugucccguccucucgaugagcgcaacaaggucaagaaagcccaggacgaauaccgggagagaaaugagaaggauaaagcugcauuugccgcugaauauggcaucgcccccaagagcagggaguucgaaaaauuucagcuguaccgagagcaacaggguaagugugcauauucguuaaagucucuggaccuucaccggguguugcaugauauuggguacgcggaaguagaccacgcccucccauauucccgcucauacgaugacaguaaaaacaauaagguucuggcucuaaccgaggagaacagaaauaaaggcaacaggacugccuacgaauaucugaccagcuuccccggaggcgagaauggggaacgguggcgaaacuuuuccguggcagucgagacaaauaaggcuuacagacucgccaaacgcacgaggcugcuucguaaggauuucucuggacgggcagccgaagaguuuagagagaggaacuugaaugacacccgcuauaucugccgauucuuuaaaaacacaguggaaagauuccugaaguuagaugcuaaggucggugcgggcgacacugccgagaucagcgcaaaacggugugugguucucucagggcagaccacagcuuuucugagggcccgcuggggacuucugaaggugcguggcaauagugauagacaucacgccuuggacgcugcaguagucgccgcgugcucccacgguauggugaaacggcucggggacuacagcaggacuaaggaacuggcuaaaguucaugauggcuucccugacccagagaccggagagauuauagauccggugauguuccaacagcuacacgcccauuuucccgacccuuggccacacuuccgcgcagaacuggaggcccgacucaacgucgaugacacagcugaucugagagcacggauggaacuuuuuggcaccuaugcccccgaggcguuggaaacucugaggccuuuauucgugucucgcgcuccacagagaaggaacucaggggccgcacacaaggacacgaucuacgcccagcccgagcggcucaaggagcaaggaggcguaacacagaaagugccgcugaccagucuuacucugaaggaucuagacaaacucauugauccucaucguaaugaaaagcuguaugcugccauccgcgcacgauuggaggcucacggugggaaagccgacaaggcguuuccagccggaaacccccugagaaagccugauagggaaggcaaucccaccgguccaguuguccggacagugaccauggugauagacaaauuaagcggcauuccuguccgcgggggaaucgcaaagaacgacacuaugcucagaguugauaucuucaggcauaaaaaggacggcaaauuucaccuggugcccguguacguauaccaugcugucgccaaggaguucccaaaucgggcuauugugcaggcaaaggaugaagacgaguggacacuuaucgaugacaaauuugauuucuguuuuuccgcccacccgaacgaccuguugaagauuacgcagaaaucuggggagaccauauucggauauuaccgaggcugccacucggguacugccgcuaucaauauugcgcuccaugauagauaugcauacgccgaaaagacaaccagccuggcuuuuuccaaaaagaacccugggaaacccaucccaaaugacaagcuaggacugaucgagggcauugguguuaagauggccgcaaacauggaaaaauuccacguggauacacuuggcaauauauaucccgccccuccagagcaacgcagggggcucgcuuga

SEQ ID NO: 2854 - RNA, 3441 nt, Artificial Sequence
  Cas9 variant
auggccuacagacugggccucgacaucgggauuaccagcgugggaugggcugucguugcacuugagaaggaugaauccggucugaaacccgugaggauacaggacuugggcguacggaucuucgauaaggccgaggacucuaaaacaggggcgucauuagcucugccucgccgagaagcccguagugcaagaaggcggacucgcagaaggcggcaccgccuauggcgagugaagagacuccuggagcaacaugggauucuuagcauggaacagaucgaggcccuguaugcucagaggacguccucuccagaugucuacgcauugcggguggccggccucgaccguugccugauugcugaggaaaucgcccgcguucugauacacaucgcgcauagaagggguuuucagucgaaccggaaaucagagauuaaggauagcgacgcagggaagcucuuaaaagccgugcaagaaaaugagaaccugaugcagaguaagggauaucgaaccgucgcugagaugcuuguguccgaagccacaaaaacugaugcagagggcaaguugguacacggcaaaaagcauggguacguuucuaaugugcgcaacaaggcuggagaauauagacacaccgucagcaggcaggccaucguggacgaggugcggaaaauuuucgcggcccagcgcgcacuggguaaugaugucauguccgaggaacuagaggacucauaccucaagauccuguguagucaaagaaacuuugaugacggcccgggaggagacagccccuauggccacgguucuguuuccccugauggggugaggcagucaauauacgaacguaugguaggaagcugcacauucgagaccggcgaaaaacgggcuccacgaaguucuuacuccuuugagagauuccagcuucugacuaagguggucaauuugaggauuuaucgccagcaagaagacggcgggcgguaccccugugagcucacacagaccgagagagccagggugaucgauugcgcuuaugaacagacgaaaauuacuuacggaaagcugcgcaaauuacuggacaugaaggauaccgagagcuuugccggucucacauauggccuuaaccgaucgcggaauaagacugaagacaccguuuucguggagaugaaauuuuaccaugaaguccguaaggcacugcaaagagccgggguguucauccaggauuugucuaucgagacacuagaccagauuggauggauacuguccguauggaaaucagaugacaacaggcgcaagaaacucaguacccugggccuuagcgauaauguuaucgaggaacuguugccucucaacgguuccaaguuugggcaccugucuuuaaaggcuauucggaaaauccugccauuccuagaggacggcuauagcuacgacguggcgugugaacucgcaggauaccaguuucaaggcaagacggaguaugucaaacagagacugcuucccccuuugggggagggagaagugacuaauccagucgugaggcgagcccugucacaggcuauaaagguugugaacgccguaauucgcaaacaugguaguccggaguccauccacaucgaacucgcacgggagcugagcaagaaucuugaugaaagaaggaagauugagaaagcccagaaggagaaccagaaaaacaaugaacaaaucaaggacgagauucgugaaauacugggcucugcucacgucacagggcgcgauaucgugaaauacaaguuguucaagcagcagcaagaguucugcauguauucaggagaaaaacucgacguuacccggcuguuugagcccggcuacgccgagguggaucauauuaucccuuaugguaucaguuucgacgauagcuacgacaacaaggucuuagugaaaacugaacagaauagacagaaggggaacaggacaccacuggaguaucuacgagauaaacccgaacagaaggcaaaauuuauugcgcucguagaguccauaccucugucucaaaagaagaaaaaucaccuuuugauggacaagcgggcuaucgaucuggaacaggagggcuuccgcgagagaaaccucucggacaccagguacauuacgcgggcccugaugaaucauauccaggcaugguuacuguuugaugaaaccgccagcacacgauccaaaagagugguuugugucaacggagcugugacugccuacaugcgcgcaagguggggccuuaccaaggaccgugacgcuggggauaaacaccaugccgcggacgccguggucguugcuugcauuggagauucauugauccaacgggugacaaaguaugacaaguucaaaagaaaugcacucgccgauaggaaccgcuacgugcagcagguaaguaagucugaggguauaacucaguaugucgacaaagaaaccggcgagguguuuacaugggagagcuucgaugaacgaaaguuucugccaaaugagccccuagaaccguggccuuucuuuagagacgagcugcucgcucggcuguccgaugaccccuccaaaaacaucagggccauugggcuuuugaccuacagcgaaacugagcaaaucgauccaauuuucguuucucgcaugccuacgcguaaggugacaggagcagcgcacaaggagaccaucagaucaccccggauagucaaaguggacgauaauaagggcacugaaauucagguugugguaaguaaagucgcccugaccgaguuaaagcucacaaaagacggugaaaucaaggacuauuuuaggccagaggaugacccccgccuguacaacacccuucgagaaagacuggugcaguucgggggcgaugcuaaggccgcauucaaagagccuguguauaagauuagcaaagacggaucuguccggacuccaguuaggaaggugaaaauccaggagaaguugacacucggcguaccggugcacgggggacgcggcauagcugaaaauggugggauggucagaaucgauguguuugccaaaggaggcaaguacuacuucguucccauuuauguggcagacguccugaagagggagcuaccuaaccggcuggccacggcucauaaaccauacuccgaauggcgugugguugaugacucauaucaauuuaaguucagucucuaccccaacgaugcggugaugaucaaaccuagccgcgaggucgacauuaccuauaaggaucgaaaagaaccaguagguuguagaaucauguacuuugugucggccaauauagcauccgcuucuauuagccugaggacucacgacaacucaggcgagcuugagggguugggaauccagggccuggaaguuuucgagaaguauguggucgggcccuuaggagacacacauccgguguacaaggaacggcgcaugccuuuuagaguagagaggaaaaugaauuga

SEQ ID NO: 2855 - RNA, 3441 nt, Artificial Sequence
  Cas9 variant
auggccuacagacugggccucgacaucgggauuaccagcgugggaugggcugucguugcacuugagaaggaugaauccggucugaaacccgugaggauacaggacuugggcguacggaucuucgauaaggccgaggacucuaaaacaggggcgucauuagcucugccucgccgagaagcccguagugcaagaaggcggacucgcagaaggcggcaccgccuauggcgagugaagagacuccuggagcaacaugggauucuuagcauggaacagaucgaggcccuguaugcucagaggacguccucuccagaugucuacgcauugcggguggccggccucgaccguugccugauugcugaggaaaucgcccgcguucugauacacaucgcgcauagaagggguuuucagucgaaccggaaaucagagauuaaggauagcgacgcagggaagcucuuaaaagccgugcaagaaaaugagaaccugaugcagaguaagggauaucgaaccgucgcugagaugcuuguguccgaagccacaaaaacugaugcagagggcaaguugguacacggcaaaaagcauggguacguuucuaaugugcgcaacaaggcuggagaauauagacacaccgucagcaggcaggccaucguggacgaggugcggaaaauuuucgcggcccagcgcgcacuggguaaugaugucauguccgaggaacuagaggacucauaccucaagauccuguguagucaaagaaacuuugaugacggcccgggaggagacagccccuauggccacgguucuguuuccccugauggggugaggcagucaauauacgaacguaugguaggaagcugcacauucgagaccggcgaaaaacgggcuccacgaaguucuuacuccuuugagagauuccagcuucugacuaagguggucaauuugaggauuuaucgccagcaagaagacggcgggcgguaccccugugagcucacacagaccgagagagccagggugaucgauugcgcuuaugaacagacgaaaauuacuuacggaaagcugcgcaaauuacuggacaugaaggauaccgagagcuuugccggucucacauauggccuuaaccgaucgcggaauaagacugaagacaccguuuucguggagaugaaauuuuaccaugaaguccguaaggcacugcaaagagccgggguguucauccaggauuugucuaucgagacacuagaccagauuggauggauacuguccguauggaaaucagaugacaacaggcgcaagaaacucaguacccugggccuuagcgauaauguuaucgaggaacuguugccucucaacgguuccaaguuugggcaccugucuuuaaaggcuauucggaaaauccugccauuccuagaggacggcuauagcuacgacguggcgugugaacucgcaggauaccaguuucaaggcaagacggaguaugucaaacagagacugcuucccccuuugggggagggagaagugacuaauccagucgugaggcgagcccugucacaggcuauaaagguugugaacgccguaauucgcaaacaugguaguccggaguccauccacaucgaacucgcacgggagcugagcaagaaucuugaugaaagaaggaagauugagaaagcccagaaggagaaccagaaaaacaaugaacaaaucaaggacgagauucgugaaauacugggcucugcucacgucacagggcgcgauaucgugaaauacaaguuguucaagcagcagcaagaguucugcauguauucaggagaaaaacucgacguuacccggcuguuugagcccggcuacgccgagguggaucauauuaucccuuaugguaucaguuucgacgauagcuacgacaacaaggucuuagugaaaacugaacagaauagacagaaggggaacaggacaccacuggaguaucuacgagauaaacccgaacagaaggcaaaauuuauugcgcucguagaguccauaccucugucucaaaagaagaaaaaucaccuuuugauggacaagcgggcuaucgaucuggaacaggagggcuuccgcgagagaaaccucucggacaccagguacauuacgcgggcccugaugaaucauauccaggcaugguuacuguuugaugaaaccgccagcacacgauccaaaagagugguuugugucaacggagcugugacugccuacaugcgcgcaagguggggccuuaccaaggaccguaaugcuggggacaaacaccaugccgcggaugccguggucguugcuugcauuggagacucauugauccaacgggugacaaaguaugauaaguucaaaagaaacgcacucgccgacaggaaucgcuacgugcagcagguaaguaagucugaggguauaacucaguaugucgauaaagaaaccggcgagguguuuacaugggagagcuucgacgaacgaaaguuucugccaaacgagccccuagaaccguggccuuucuuuagagaugagcugcucgcucggcuguccgacgaucccuccaaaaauaucagggccauugggcuuuugaccuacagcgaaacugagcaaaucgacccaauuuucguuucucgcaugccuacgcguaaggugacaggagcagcgcacaaggagaccaucagaucaccccggauagucaaaguggaugacaacaagggcacugaaauucagguugugguaaguaaagucgcccugaccgaguuaaagcucacaaaagauggugaaaucaaggacuauuuuaggccagaggacgauccccgccuguacaauacccuucgagaaagacuggugcaguucgggggcgacgcuaaggccgcauucaaagagccuguguauaagauuagcaaagauggaucuguccggacuccaguuaggaaggugaaaauccaggagaaguugacacucggcguaccggugcacgggggacgcggcauagcugaaaacggugggauggucagaaucgacguguuugccaaagauggaaaguacuacuucguucccauuuauguggcagacguccugaagagggagcuaccuaaccggcuggccacggcucauaaaccauacuccgaauggcgugugguugaugacucauaucaauuuaaguucagucucuaccccaaugaugcggugaugaucaaaccuagccgcgaggucgacauuaccuauaaggaucgaaaagaaccaguaggccugagacuuauguacuuugccggugcagacaucucgggcgcuacuuugacacugaggacccacgacaacuccggggaguuaaagggacucggcauacaggggcuggagguguucgaaaaguauguugugggaccccuuggcgauacacauccggucuacaaagagcggcgcaugccuuuuagaguggaaaggaagaugaauuga

SEQ ID NO: 2856 - RNA, 3447 nt, Artificial Sequence
  Cas9 variant
augaccaagcugaaccagcccuacggcaucgggcucgacauuggaagcaauuccauagguuucgccguggucgaugcuaacucucaccuucugagauugaaaggcgagacagcaaucggggccagguuauuucgggaaggacaaucagcggcugaccgccgaggcagucguacuacgagaaggcggcugagccgcaccagauggaggcuauccuuccuccgggauuucuucgccccucauauuacaaagaucgacccagacuuuuuccugcgccagaaauauucugagauuucgccgaaggauaaagaucgauuuaaguacgaaaagagacuuuucaaugacaggacugaugcagaguuuuaugaagccuaccccucaauguaucaucugcgguugcgucucaugaccgacgcuagccaggcagauccucgcgagaucuuccuggccauacaccacauccugaaaaguagaggucauuuucucacaccaggggcugccaaggacuucaacaccgauaaaguugacuuagaggacauuuuucccgcgcugacugaagcauacgcccagguguauccugaucuugaguugacauucgaccuggcuaaggccgaugacuucaaagcaaagcuacucgaugaacaagcuaccccauccgacacgcagaaggcccugguaaaucuucuguugucuagcgauggagagaaagagaucgugaagaaaaggaagcagguccucacugaauuugcgaaagccauuaccggccugaagacaaaauucaacuuagcacugggcacugagguggacgaagcugaugccuccaauuggcaguuuucaauggggcaacucgacgauaaguggaguaacaucgagaccagcaugacagaccagggaaccgaaauauucgagcagauucaggagcuuuaccgggcucgacuguugaaugguaucguucccgccggcaugucucuaucccaagcaaagguggccgacuacgggcagcacaacgaagaucuggagcucuuuaaaacguaucugaagaaacuuaaugaccacgaacuggcuaagacuauucgcgucaucuacgauagauauaucaacggagacgaugcgaaaccuuucuugagggaggacuuugugaaggcacucacaaaggaaguaaccgcccauccaaaugagguuucagagcagcuguuaaaccggaugggccaagcuaauuucaugcugaaacagcgcacuaaggccaacggugcaauuccggugcagcuacagcaaagagaacucgaucagauaaucgccaaccagagcaaauacuaugacuggcuggcuaagcccaauccugucgagaaacacagggccaguaagccauaccagcuugaugaauugcugacauuucguauucccuauuacguggggccucucaucaccccaaaggagcaagcaaaaucuggagaaaacguguucgcguggaugguccggaaggaccccuccggcaauauaacgccguacaacuuugaugagaaaguugaccgagaggcuagcgccaauguguucauucagagaaugaagaccacagauacuuaucugaucggcgaagacguacuuccuaaacagucgcuguuguaccagaaguaugaggugcucaacgaacugaauaacgucagggugaauaacgaggcauuagggaccgaccaaaagcagcgccugauccgggagguuuuugaaagacauucuuccgugacaauuaaacaggucgccgauaaucuaguggcucacggagacuucgcccagaggcccgagauccgcggucucgcagaugaaaagcgauuccugucaagucuuagcacuuaccaccaauugaaagagauucugcauggcgcuauagacgauuccaccaagcuccacgacaucgaaaacauuaucacauggucuaccguauuugaggaugccgcgaucuucaaaacuaagcuggccgagauugacugguuagaugcugcaacgauaaagaagcugagcaauauccgguaucguggguggggacaguuuucaagaaaacuuuuggacggccucaaacuggguaacgggcagacaguuauucaagaacuaaugcugaguaaucauaaccucaugcagauccugaccgaugagacucuuaagaccacaauggccgaauugaaccaggacaaacugaaggcugaugacauugaggacgugaucaaugaugccuacaccuccccaagcaacaaaaaggcauuaaggcagguccuccgcguggucgaagacauaaagcacgcggccaauggccaagauccuucuuggcuguauaucgagacugcugacggacccggcacagccgggaaacggacgcagucaagacagaagcagauucaaaccguguacgcaaacgcugcccaggagcuuaucgauagugcaguuaggggagaacuggaggacaaaauugccgauaaggcuagcuucacugaccgauuggugcucuacuuuaugcaggguggccgcgauaucuauacaggggcgccacugaauauagaccagcuaucccauuacgauauugaccacauccugccccaaucucucauuaaagacgauucgcuggacaaccggguacuugucaaugccaccaucaacagagaaaagaauaacguguucacaagcacuuuguuugcauccaagauggcugccaccuggaggaaauggcacgaggccggacugauaucaggccguaaguuacgcaaucucaugcugcggccugaugaaaucgacaaauucgcucaugguuuuguugcaagacagcuuguggagacgaggcagauuaucaagcugaccgagcaaauugccgcggcucaguauccaaacacaaaaaucauagccgucaaggcagggcuaagucaccagcuccgagaggaacuggauuucccgaagaaucgggacgugaaccauuaccaccacgccuuugaugcuuucuuggcagcccgcauuggcacuuaucuguuaaaaagauacgcgaagcucgcucccuuuuucaccuauggagaauuugccaaaguagacgugaagaaauuuagggaguucaauuuuaucggcgcacugaagcaugccaaaaagaacaucguugcuaaggauacaggggagauugucugggacaaagaacgggauauccaggagcuugaccgaauuuacaacuucaagagaaugcugauaacucacgaaguguacuuugagaccgccgauuuguucaaacaaacgaucuaugcagcuaaggacucuaaagaacgcggagguagcaagcagcucauuccuaagaaaaggggcuacccaacacagguguaugggggaauccauggcaagauucgucugaccuggcgguggcuaaaacugcuuagaaggaagaaaauguccaucgagcucucagagcugcaguugcugaaguga

SEQ ID NO: 2857 - RNA, 3450 nt, Artificial Sequence
  Cas9 variant
auggagagauaccacaucggccuggacauugggaccagcuccauaggaugggccgugaucggugaugacuucaagauuaaaaggaagaaaggcaagaaccucaucgggguccggcuuuuuaaagaaggagauacagcugcagagcgccgaggcuuccguacucaaagaaggcggcugaaucgcagaaaguggagguugaaguuacuggaagagauuuuugaccccuauauggccgaaguugauaaauacuucuuugcgcggcuaaaggagucuaaccucucaccuaaagacaguaauaagaaauaucuggguagccuucuguucccagauaucuccgacucuaacuuuuacgauaaguauccgacgauauaccauuugcgccgagaccucauggagaaggauaaaaaguucgaccugagagaaaucuaucuggcuauucaccauaucgugaaauacagggggaauuuucucgagaagguacccgccaaaaacuacaaaaauucgggagcaucaauuggcuucuuacuggaagaggugaacgaucuuuauggcaauaucauagggaacgaggacgucgccauuuuggacaaugauaaauuugaagacguggagaagaucauucugaacgaugaaauccggaauaucgacaagcaaaagaacguuggacgucuacucgugaaggauaaaaaggagaaaaauauugucaccgcuuucagcaaggcaauauuugguuacaaguucaaccuggaagaccuucuguugaucgagagugaugagaaaaacaagcucacauucaaugacgaaaacauugaugacaucuuuaaugagcugucccacucuuuaaacgauaaucagauggaccugcucacuaaaacccgcgaaauauauuucaaguuuaaacuuaacaugauugugccuacaggcuacaccaucagcgaguccaugaucgaaaaguaugagaugcauaaggcccaccugaaaauguacaaggaguucauuaauacuuugaacgcuaaagacagaaagauccuuaaaaaugccuauucagauuacauuaacaaugaaaaggcgaaggcagccaacgcucaggagaauuuuuacaaaacaguaaagaaaaccauaaaggaaaacgacagugauacggccaaaaagaucauugggcugaucgacgagggaaauuucaugccaaaacagaggacuggcgaaaacgguguuaucccccaccaacuccaucagauugagcuggaucggauaaucgagaaccaggcaaaguauuacccuuggcuugcugaagagaauccaguggaaaagaaccgaaaauuugccaaguauaaacuggacgaguuggucaccuuccgcgugcccuacuauguggggccucucauugauaagacagagagcaauaaaaacgaaaaggagacuaaguuugcguggauggucagaaaagccaagggaaccaucacaccauggaauuucgaaaaccugguugacaggaccgagucugcaaaucgguuuauuaaacgcaugacguccaaggauacuuacaucauaggcgaagacguguuaccggcuucaagccugcuauaugagaaauacaagguacucaacgagcugaauaacaucaaggugaauaaaaagaaacuugaugucgaacagaagcaacacguguacuuggaccuguucacaaccaggaaaaacguuacuaaggaugaccucgccacaagucugaauugcgacguggagucuauuaccggccuuacggauaacaagaaauuuaauuccagccugucgucuuauaucgacuugaaggcuauucucgggaacaucgucgaugacuacuccaaaaacgaagaucuggagaagauaauugaauauucaaccaucuucgaggacggaaauauuuacaaagagaaguuaagugaaaucagcuggcugacagaugagcagauagaaaaacuauccaacauccauuucaaggguuggggcagacucucuaagaaacugcuuacucagauuaccaaugagaacggggaacguaucauugacacauuguggaauacuagcaacaauuuuauccaggugauaucagaugagaguauucaagccaagcuggcagagaucaacggagaauaugccaauaaauacaaccucgaggacauccuggaugaggcuuauaccagcccccagaauaagaaagcgauucggcagguaaugaagguuguggaagacaucgagaaggcaaugaaaugugaaccuacauccauugccauagaguucacccgagaaaagagaaaaucuaaguuaacuaacacgagguacaaaaagaucucagagacauacgaaaagauuaccgaugagcugaucagugaguaugaacuuggcaaauugcaaagcgagcucgacuccaaggucaauaacaugcgcgaccgguacuaucuguacuuuaugcagcuagguagagauauguauacuggggagaaaaugaauauugacgaacugcaccagaaguacgauaucgaccacauacucccacagucuuucaucaaagaugacucgcugaacaacagggugcuuaccagcaaguccgucaauauuaaggaaaaaucagauaagacagcugccgacuuguaugcagccaaaaugggcgauuuuuggcgcaagcugcgaaaacaaggauuaaugaccgagcagaaguacaagaaccuccugacucggacagacaguaucaauaaauacacgaagcagucuuucauuaaacgucagcuuguggagaccagccaaguugugaagcuggcugccaacaucuugcaggauaaauauagaaauacuaagauaauugaaaucagggcacgccucaacuccgaccugcggaaaaaguacgagcuaaucaagaauagagaaguaaacgacuaucaucacgcgauugauggcuaccugacaaccuuugucgggcaguaucucuacaaaguguaucccaagcugaggucauacuucguuuacgacgauuuuaaaaagcuagacagcaauuauuugaaacauauggauaaguucaacuuuauauggaagcuggaggacaaaaaggcugaagauguguacgacaaagucaaugaugaguucguguuaaacguaccugagaugaaggaauauauccgaaaaauuuacaauuauaaguacaugcucgugucuaaggagguuacaacuaaaaacggagccuuuuaugaccagaccaaguacaaugcaaaaacgaucaaccugauuccaaucaagaaagauaagcccaccaauauauacgguggcuauaaggggaaagucuccaguuacaugaugcuugugaagauccagaaaaagaaagaagugauuuauaaguucgucggaguuccgcgccuguggacagacgagcuagaucggcucaucgacacugacgagaaaaaggcccuguugaagaaauga

SEQ ID NO: 2858 - RNA, 3459 nt, Artificial Sequence
  Cas9 variant
augaacgccgagcacggcaaggaagggcugcucaucauggaggaaaauuuccaguacagaauuggacuugacauagguaucaccagcgugggcugggcuguccugcaaaacaauucccaggaugagcccguuaggauuacagacuugggggugcggaucuuugauguagcagaaaacccuaaaaauggagacgccuuagcggcuccacgccgagaugcccguacuacgagaaggcggcugcgcagaaggcggcaucgccuagagcgaauuaaguuccuccugcaggagaacggccuuaucgaaauggacucuuuuauggagagauauuacaaagguaaucugccggauguguaucaguugagguacgaagggcucgaccggaagcugaaagaugaggagcuggcacaaguccucauacacaucgccaagcaucguggauuccgcucaaccagaaaggcugaaacaaaagagaaggaaggcggcgcaguguuaaaagccacuaccgagaaccagaagauuaugcaggaaaaaggguauaggacaguuggagagaugcuguaccuugacgaggcuuuucacaccgaaugcuuguggaaugagaaggguuaugugcugacuccccggaaccgaccugaugacuacaagcauacaauccuacgcaguaugcucgucgaagaggugcacgccauuuucgcggcacagagagcccacggcaaucaaaaagcuaccgaagggcuggaggaggccuacguagaaaucaugacgagccagagguccuuugauaugggaccaggccuucagcccgacgguaagccuucuccauaugcaauggagggguucggagaccggguuggcaaauguacuuuugaaaaggaugaguaccgcgcucccaaagccaccuauacagcggaacuguucguggccuugcagaagauaaaccauacuaaacucauugacgaguuuggcaccgggagauucuuuucggaggaagagaggaagacaaucauuggacuguuacugucaagcaaggaacucaaauacgguaccauccguaagaaacuuaauaucgauccuagucugaaguucaacuccuugaauuauucugcuaaaaaggagggcgagacggaagaggaacggguccuagacacugagaaggcuaaauucgccagcauguuuuggacauacgaauauuccaagugccugaaagaucgaaccgaggagaugccagugggggaaaaggcugaccucuucgauagaauuggagagauacugacugccuacaaaaacgacgauucaaggaguagccgccuuaaggaacugggcuugucuggugaggaaaucgacgggcuccuggauuuauccccggcaaaguaccaacgggugucacugaaagccaugagaaagaugcagcccuaucuagaggacggccucauuuacgacaaagcaugugaggcggcaggauaugauuuuagggcccugaacgacggcaauaagaaacaccuuuugaagggggaagagaucaacgcuauagucaaugauauuacaaacccuguugugaagcgcagcguaagucagaccaucaaagugaucaaugccauuauccaaaaguacggaucuccacaggcagucaacauugaacuggcccgagagauguccaaaaauuuccaggaccggacgaaccucgaaaaggagaugaaaaagcgucagcaagagaaugaaagagcuaaacagcagauaaucgagcuggguaagcagaaccccaccggccaagauauucuuaaguauaggcuguggaaugaccaagggggauacugcuuguauagcggcaaaaagaucccucucgaggaacuguuugaugguggguacgacaucgaucauauuuuaccauacucgauaacauucgacgauucuuaucgcaacaaagugcugguuacugcccaggagaaucggcagaagggcaacagaacccccuacgaauauuuuggagcagacgagaaaaggugggaagauuacgaggcguccgugcgacuacucguccgcgacuauaagaagcagcagaaacugcuuaagaaaaauuucacagaagaggagcggaaggaauuuaaagagagaaacuugaacgacacuaaguacaucaccagggugguauauaauaugauucgucagaaccuggaacucgagccguucaaucacccugaaaagaaaaagcagguuugggcugugaacggcgccgucacaucauaccugcgcaaacgguggggguuaaugcaaaaggauagaaguaccgacaggcaccaugcaauggaugccguggucaucgcuuguugcacugacggaaugauucacaaaaucagccgauacaugcagggucgggagcuggccuauucccgcaauuuuaaguuccccgaugaggaaacgggcgagauacuuaacagagacaauuuuacaagggaacagugggaugagaaguucggggugaaaguuccauugccuuggaacucuuuccgggacgaacucgauauccgacugcuaaaugaggaccccaagaacuuucugcucacccaugcagaugugcaaagagagcuggacuacccaggauggauguauggcgaagaggaaagccccauugaggagggucgcuacaucaauuauauuaggccucuuuucguaucacguaugccaaaccacaaagucacugggagugcucaugaugccaccauccgguccgcgagagacuacgaaacaaggggcgugguuauaaccaaggugccguugacugaccugaaauuaaauaaggauaacgagauugaaggauauuacgacaaagauagcgaccgccuccuguaccaggcccuuguccgacagcuguugcuccacggcaaugaugggaagaaggcuuuugcagaggacuuccacaaacccaaggccgauggaacagaaggcccugugguaagaaaagugaagaucgagaaaaagcagacgucugguguuaugguccggggagggaccggcauugcugccaacggugagauggugaggaucgacguguuucgcgaaaacggcaaguauuacuucgucccaguuuauacugcagauguggugcguaaaguacugcccaauagagcggccacacauaccaagccuuacucagaguggcgggucauggacgaugcuaacuuuguguucagucuauauagcagggaccugauacacguuaaauccaagaaagacaucaagacaaaucucgugaacgggggacugcuuuugcaaaaggaaauuuuugccuacuauacuggcgcagauaucgcuaccgccucuauugcaggguucgccaaugacucgaacuuuaaauuccgcggacugggcauccagagcuuagagauauuugaaaagugucaggucgauauucucgguaauaucuccgugguucgacaugagaacagacaggaguuccacuga

SEQ ID NO: 2859 - RNA, 3462 nt, Artificial Sequence
  Cas9 variant
augaagaacauccugggccucgaccuugggcugagcuccauuggauggucugugauaagagagaauagcgaagaacaggaauuggucgccauggguaguaggguugugagcuuaaccgcugcagagcuguccucuuucacacaaggcaacgggguaucgaucaauucacagcggacucagaaacgcacgcagcgaaagggauacgaucguuaucaacuaagaaggacccuccugcggaacaaacuugacacacugggcauguugcccgaugacagccucaguuaccugccuaagcugcagcucugggguuuacgcgccaaagcggugacucagagaauugaacugaaugagcuugggagggucuugcugcaccuaaaccagaagcggggauauaaguccaucaaaucugauuuuagcggcgacaagaaaauuaccgauuacgugaagacaguuaaaacccgcuaugacgagcucaaggaaaugcgacugacuaucggcgagcuuuucuuuagaaggcugacagaaaaugcuuucuuucggugcaaggagcaaguguacccacgucaggccuaugucgaggaguucgauuguauaaugaacugccagcgcaaauuuuacccggacaucuugaccgaugagacgauuagauguaucagggacgaaauuaucuacuaucagcggccccucaaguccugcaaauaccuggugucacgaugugaguucgaaaagcgcuuuuauuuaaaugcagccgggaaaaagacugaggcuggaccuaaaguaaguccaagaaccagcccccuguuccaaguuugcaggcucugggagucuauaaacaauauuguggucaaggaucggcgcaacgaaaucguguuuauuuccgcagagcagagagccgcucuuuucgacuuucugaauacacaugaaaaguugaaagguucagaccuacugaagcuccugggccuuagcaaaacuuacggguauaggcugggagagcaguucaagaccggcauccaagguaacaaaacacguguggaaaucgagcgggccuuggggaauuacccugauaagaagcgacuccugcaguucaacuuacaggaggaaaguucuuccauggucaacaccgagacgggagaaauuauaccaaugaucagccugucguuugagcaggaaccccuauauagacucuggcacguucuguacucuauugacgauagggagcaacuucaguccguguugcgccagaaauucggcaucgacgaugacgagguacuggaacggcucucagcgauagaucuggugaaggcaggcuuugggaauaaaaguagcaaggccauuagaaggauccuuccuuuccugcaguugggaaugaacuacgcugaggccugugaagcagcugguuauaaucauuccaacaauuacacuaaagccgagaacgaggcgcgcgcccuccuggaccgauuaccagcaaucaagaagaaugaacugcggcaaccggucguggagaaaauucuaaaccagaugguuaauguggucaacgcucucauggaaaaguauggccguuuugaugagaucagaguggaacuggccagggagcuuaaacagucuaaggaggaacgcagcaauacauacaaaucaauuaacaagaaucagcgggagaacgaacaaauagcuaagagaaucguagaguaugggguucccaccaggagucgcauucagaaauacaagaugugggaagaguccaaacacugcuguaucuauugcggacagccuguggacgucggcgauuucuugcgagguuuugacguggaggucgaacauaucauuccaaagagccuguacuucgacgauucuuuugccaauaaaguguguucaugccggaguugcaacaaggagaaaaacaauagaacugcauacgacuauaugaagucaaagggggaaaaagcccucuccgauuacguugagagggugaacacaauguauaccaauaaccagauaucuaagacgaaauggcaaaaucuguuaacccccguagacaagaucucgauugauuucaucgaccgucagcugcgcgaaagccaguacauugcucggaaagcgaaggagauccuuacauccauauguuauaacgucacugcaaccucaggcagugugacaucuuuucuuagacacguuuggggaugggauacugugcuccacgaccugaauuucgauagguacaagaaagucggccuaaccgaggugaucgaaguaaaccaucgagggagcgugauucggcgcgagcaaaucaaggacugguccaaaagauuugaucacaggcaucacgccauugacgcucugacaaucgccugcaccaagcaggcauauauacagcggcucaauaaccugcgagccgaagagggaccugauuucaauaaaaugucacuugagagauacauucagagccaaccacacuucucuguugcucagguccgcgaagccguggacaggaucuugguguccuuucgugcagguaagcgggcggucacucccggcaagagauacauuaggaaaaaccgcaagcgaaucaguguucagagcgugcugauaccgagaggggcuuuaucugaggaauccguguauggaguaauccaugucugggagaaagacgaacagggccacgugauucaaaagcagcgggccguuaugaaauacccuaucacgucaauuaauagggagaugcucgauaaggagaagguggucgacaaacgcauccaucguauacugagugguagacuugcacaguauaacgauaaucccaaggaagccuucgcuaaaccaguguacauugacaaggagugucggaucccuaucaggacaguucgcugcuuugccaaacccgcaauuaacacccuggugccauugaagaaagaugacaaggggaaccccguagcuugggucaauccuggcaacaaucaccauguggccaucuaucgagaugaagacggaaaguacaaagagagaacugugaccuucugggaagcggucgaucgguguaggguuggcauuccagccauagugacacagccggacaccaucugggauaacauucuccaacgcaaugacaucagcgagaacguacuggagucgcuacccgaugugaaguggcaguuuguccugucccuccagcaaaaugaaauguucauucuggggaugaacgaggaagacuauagauacgcuauggaccagcaggauuacgcacuuuugaauaaauaucuguacagggugcagaaguuaucuaaaagcgacuauucauuucgguaccacacugagacaaguguugaagauaaguaugacggaaagccuaaccucaaacuguccaugcaaauggguaaguugaaacgugugucuaucaagagccugcuaggccucaauccacacaaaguccauauauccgugcugggggagaucaaggagauuucauga

SEQ ID NO: 2860 - RNA, 3474 nt, Artificial Sequence
  Cas9 variant
augaacuacuauaauggcuucaucauuaccgagaacgccaugacaagcaagcaggaaaaacacggggcucugacuuuuggacucgacauagguaucgcauccgugggcugggccguccuuggggagucuagaauuguugaucugggagugaggugcuucgacaaggcggaaacggcuaaagagggcgaaucauugaauuuaacccggcgcauggcccgacugcuacguagaaggcuccggcgcagagcauggaggcugacaaaacuugcccggcuguugaaacgcgagggucucaucgcugaugcaaaccuguuuaagcauaagauugagaaaaauacucccguaccuaagaguagcuggcaacugcgaguggacgggcucgauagacaguuaaacgccgaagagugggcuagggucaucuaccaccuguguaaacaucggggauuccacuggauaucccgugccgaagagaaggcggcagagggcgacucuaaaggcgaagggggaaaggugaagcagggucuugccggcaccaaaaaguugaugcaggagaaaucguaucgcacagcugccgaaaugguucuggcagaguuuccagaugcucaaagaaauaagcagggggacuacucaaaagcccuaagcaggauccuccugggagaugaacuuaaggcgcuguucgagcaucagcggaaauugggcaacccgguggccaccgagaagcucgaagcagcuauucuggguaauggggacaagaaaugcggauuauuuugggcccagaaccccgcucuggccggcaauaagcuccuugagaugcugggccgauguacuuucgaaaagacagggggagaugacgguaagggcgaguaucgcgcaccuaaagccaguuuuuccgcugaaagacacgucugguugacccaccuaaacaaucugaggaucgugguagaugggacgacucggccacucaacgaggcggagcgcagaguugcacugcccaugccuuaccaacaggccggagaccuuucuuauaagcagcugggcggugcuuugauuaaggaaggguuccuccagaaagacggcuuuaaguucgccggacugccauaccccaccaaacaagcaagcgaggaaaaggccaaagauccugagacauccguguuaugcaagcugccagcuuggcauacucuaaggaagacccucgaaaaacacggccuggagucagaguggcagaaacuuaguacagacgccuuggaugggaagccgcagcugcucgacaauaucgcauggguccugagcguguacaaggaugacgaugaagugaaaaccgagcuuggaaagcugaacuugcccaacacggaaaagaugauagacgcgcuccuggauauucguuuugacaaauucucuaauuuaucccugaaggcucuaucaaaaaucgucccuuucauggagcaaggucagcgguaugaugaggccguugcaaacauuccagaauacggccaucacagccagcuccacaaggugggggccggagagcauaaauaucugcccccuuuuuacaaggaacgagacaaaacuggcagaaugguauucaaugacgauauggacaucccaaggaaccccgugguccuucgcgcuuugaaucaggcccggaaggugguuaacgcacugaucaaggaguaugguaguccgcacgaagugcauauugagauggcuagagaucucucuaggccucuggacgagcgccgagauauagaaaaauuacaaaaggaguuuggggaacggaauaaaaaggacaaagagcuguucgcccaggauuuuaacaucgucggcacagugaagggaaagcaguucgaaaaauaccagcuuuaucgugagcaacagggcaaguguauuuaccccuccauggacgagaaacaggggaucugcuguuacagcuugaagccacucgaucugcacagaguacuauaugaagagggauacgcggaaauagaccaugcccugccuuauucgaggucuuuugaugacuccaaaaauaaccgcguucucgugcuggcuaaggagaaucgggauaaggguaacagaacccccuucgaauaccuuggcgacaaagacaauucagagccauggaggcaguuugucgcauucguggaggggaacaaggccuaucgauuggcuaaacgcagucggcuguuaagaaaggauuuuggagacaaagaagccaaggaguucagggaacguaaucucaacgauacucgcuacauuugcaaguuuuucaaaaacuaugucgagcaauaccugcagcuucacgaggacagcgaagcaaagcggugugugguucuguccggccagaugacaucuuucuugagagcgagguggggucucgugaaaguacgaggggauagcgaccggcaccaugcccuggaugcugccgucguggcagcuugcucacacggcaugguuaagcgccuaagugacuacuccagaaggaaagagcuggaacaggugcgggagggauuugucgauguggacaccggcgaaaucguaaaucccgccauguuccaacaggugcaggagcauuuuccuaacccauggccgcacuuccgagaugagguuaagcucagacugagcaucgacgaucccacgcuuuugcgcucugaaauggagaaauuugggaccuauacaccugaaucacuggaggcauuaaggccacucuucgucagucgugcuccccaacggagaaauagcggagccgcgcacaaggacacuauuuacgcccagccuaagaggcugguggcacagggcggugugacccagaaagucgcucuuuccucucugacacuaaaggaccucgauaaacugaucgacccacaucgcaacgaacgauuguaugccgccauuagagcucggcuggagcaacacgggggaaagggcgauaaagcauuucccgccucgaauccguuaaggaagccugacagcgaggguaacccaacuggccccauaguucgcggggugaccauggugaucgauaagcucuccggcauuccuauccguggagggaucgcgaaaaaugacucaaugguaagagucgauguguucacaaaggcuaacaaauuucaucugguucccguguacguccaccauagugugcuuggacugccaaaucaggccauuguuggcgguaaggaagagucugaauggacccagauagacgauagcuucgacuggcacuuuuccaucuauccuaacgauuugauucgggugacucucaaacaggaggggagguucggauacuaugcaggcugugaccgcucaacggccgcuauccaccugugggcacaugaccgaaaucaacagguagguaaggauggccuaauuagaagcaucggggucaagacagcccugucuauagaaaaauuuaacguggacgugcuuggaaaucgguaccccgcgccaccggagaagaggcgcgaucucgcuuga

SEQ ID NO: 2861 - RNA, 3486 nt, Artificial Sequence
  Cas9 variant
augaagaaaauccugggccucgaccuugggagcgccuccauuggaugggcucugguggaggaaaccgagcagaugcaauacaacauagucucuuuggguucaagaaucauucccuauaauggcacagaagggcaggaguucgaaaagggaacuggcgagaguaggaacagcuuacggacgaaagcacgcaccgcccgaaaggguuacgaucguuaucagcugagaaggaaaaaucuagagaagauccuccugcagaacgggauguacccuaaugaacaaguucgggcgcuucagaagcuggaguuguggaaacuccgcgcugacgccccaaacgugcagauuucccugccggaacugggaagacucuuauuuuggcugaaucagaagaggggcuauaaaucuucgcggucagaugcaaaccuugacaagaaagauacagaguacguagccacugucaagagccgccaccaaaagaucaaagacgcuggccagaccguggggcaguauuucuacggacagauauuggagaaugaauaccaucgaaucaaggagcaaguguuucccagagaagcauauauugaggaguucgaugccaucguugcuaggcagaaagaauacuauccuacaauucugaagcaggagcuaaucgacaaaauacggaacgaagugauuuacuuucaacguggucucaagagucagaaaggccuggucuccgugugcgaguucgaagggcgcgaguuuaauggacacuucggcgguccaaagguagcccccaagucuagcccuaucuuucagcuugggaaaauuugggaaaacaucaauaacaucaagauugcggauauagagcugaccgcagagcagaaauugguuuucuuuaauuaucucaacugucaugaaagaaucacugaggccaagauuagggaacuguuaaaacuguccaaggacucacggcucaacggacaacuuaagaauggccugacaggcaacaaaaccuacagucagaucgcuagcugcuucgggaauaagauaggagaguaugaacgauuguuuaaauucgagcuagaggugauugaaucugagaagcuggaauacacguaccacccaaaaucccauauccccgucggugagaagcgcagaaaguauaucucagagaacguggaaaaagagccuuacuauaggcucuggcacacuauuuacagcaucaaggauaaagacgaaugucgggccgcacugauuaagaauuucggcauagaggaagagaucgcugagaaacuugccagucuggauuuuucugccgggggauucggcaacaagugcgcgaaggugauucgcaaaaucuugccauaucucauggaaggugacaaguacaaugucgcaauggacuaugcuggguacaaccacuccuuuagccagaccaaagaugagaaucugcagagaguuuuacuggacucgaucaaccaucuaccgaaaaauucucucaggcaacccauuguggaaaagauacugaaccagaugaucaaucuuguaaacgaggugauuaagcaguggggccguccugaugaaauccgggucgaguuggcccgaaaacugaagcaguccaagacagagagaaaugacgaugacaacuucaugaggaaacgcgaacgggagaacgaaauuaucaaggcugaucucgccaaauacggacugaaggcaacuagaaauaacgugauaaaauggaggcuuuaucacgagaucgacgauaaggacaagaaacugaaugcccgcuguauuuacugcggccaaccaaucucauugaccgaagcuauucucgggaacaauguugauguggagcauaucauacccaaggacaaacuguuugacgauagucagagcaacaagacauuagcgcaccgauccuguaauucuggaaaagguaacaagaccgcauaugacuucaugaaggauaaaccucaguuugaggaauacgucgcccggguggaggaacuguauaagaaacaccuaauuagccucacgaagaaacguaaguuccugaugucagaggacaagaucccaagugauuuuauugacagacagcuuagggagucccaauacaucgcucgcaaaagccgggaaauauugcagacuguaugcagaaauguuuggucuacagauggcggggugaccgcccaucugaggaagcucuggggaugggacgaugucacuaugaaccugcagaugcccaaauauaagggcaucgguaugacagagauuguggaaugggagucaaaucacgggaaaaaccaacauacccaggaagucaucaaggacuggaguaaacgagaugaccaccgccaucacgcaauugaugccuuagugguugcuuguacgcggcagggcuacauccagagaauaaauacccugaacagcuccgagacaaaggacgagaugcacaggaagguggccggaucucuuguagaguucaaucaaaaacauacuuugcucaacaaguaccugauuaccgaaaaaccguuuacaacuucggaagucgaggacgugguuagcaagauccuaguguccuucaaagcaggcaagaaggcggcuaccccugggaaacguaaggucggaaaacgcgguaacaaacaggugguacaggauggcaucauuauccccagaggggcccugcacgcagacucagugaguggaucuauuaaacaguaugauccaacaggcaauuuugaaaaccauaauguuauaaaguacaaggucgguguggggaaaggcuaucucuucgacggaaaggaugacaaaaagaaaaucgauaagaccauugacugcaucguggauaagaaaauucgggaccugaucaagcaaagggccgaggagagcaacuacucccuuaaaaagauguucgaaacuccuauauuguuuaaucagcgagcugucuucucaguucgguguaaaacgggcaacaaggccguggugcccauccgcaauggguauguagucccagauaacaaucaccacacagcaauuuacaaguaugacggaggccugaaagagcagugcgugagcuuaaugcaggcuaucgaaagaaagagguacaaccuccccauuaucauaaagaauccuaaggagauuuacgauaaaaucaccgaaaucgccaacauuaaucaacugcuuuuugacucucugccaaaguuggacugggaguucguuacuacccuccagaaaaacgauauguuuauacuggguauggacuauuccgcgacagaggaagcccuagcugaugggaauuaccggcugcucagugaguaucuguacaaggugcagaacaucagcgacggaauuuaucgacuuugccaucacaccaucacuaaguucgauuugucuaaagcaaacaagccggacaaaagauuuuacaauauucaaucccugaaggccuggaacacauuaaauccccagaaagucaagaucaacauacucggccagaucgaacgccaguga

SEQ ID NO: 2862 - RNA, 3501 nt, Artificial Sequence
  Cas9 variant
augcacguggagaucgacuucccccauuuuagcagaggcgauucccaccuggccaugaacaagaaugaaauucucagggggucuucaguccuuuaccggcugggauuggacuuagguaguaacagccugggcugguucguuacccaucuagagaaacgcggggaucgacacgaaccuguggcucucggaccaggcgguguacguauauuuccggacgggagagauccccaguccggaacaucuaaugcaguggacaggcggauggcccgcggcgcgagaaagaggcgggaucgcuucgucgagcgaagaaaagaacugaucgcugcccuuauuaaguauaaccuguugccugacgaugcaagggagcggcgugcccucgaggugcuggacccauacgcucugcgcaaaacugcacucacggauaccuuacccgcccaucacguuggcagagcucuguuucaccuuaaucaaaggcggggguuccagucgaaccgaaagacagacucaaagcagagcgaagauggagccaucaaacaggcggcaagucgcuuggccacugacaaggguaaugagacccugggcguguuuuucgcugacaugcaucuaagaaaauccuaugaagauaggcaaacagccauucgggcagagcucguccgccuggggaaggaccaccuuaccggaaacgcuaggaaaaagaucugggccaaggugagaaaacgucuguuuggcgaugagguauugccucgggcggacgccccacaugguguucgagcaagagcuacuauaacagggaccaaggccucuuacgauuauuaccccacgagggacaugcuccgcgaugaguucaaugcuaucugggccggacagagcgcacaccacgccacuauuaccgacgaggcucggacagaaaucgagcauauuaucuuuuaucagagaccucugaaaccagcgauagugggcaagugcacuuuagauccggcaaccaggcccuucaaagaagacccugagggcuaccgcgccccauggucccacccccuggcucagcgauuucggauucucucagaggcccguaaccuugaaaucagagauacagggaagggaaguaggcgccugaccaaagagcaaagcgacuuggucguggcagcccuacuggcuaaucgggaagugaaguucgacaagcucagaacgcugcuuaaacugccugccgaggcaagguucaacuuggaaucugaucgacgcgcggcucucgacggugaucagacugccgcacggcuguccgacaagaaaggcuuuaauaaggccuggagaggguucccacccgagaggcagauugcuaucgucgcccguuuagaggaaacagaggaugaaaacgagcugaucgcauggcuagaaaaagagugugcucucgacggagccgcggccgcucgcguugcaaauaccacucugccggauggccauugccggcuugguuugagagccauuaagaagauagugccuaucaugcaggacgggcuggaugaggacggcguagcuggagccggcuaccacauugcagcgaaaagggccggguaugaucaugcuaagcuccccacaggagaacaacugggucgacuuccauacuauggccaguggcugcaggacgccguggucgggucaggagaugcacgggaccaaaaagagaagcaguacggccaguuuccuaaccccaccgugcacaucgguuuggggcagcuccgcagaguugugaacgaccugauagauaaauauggcccacccacggaaauuagcaucgaguucaccagggcuuuaaagcugagugagcaacagaaggccgaacggcagcgagagcagagacgcaaucaagacaaaaacaaggcaagggccgaagaacuagcuaaauuuggacguccugcgaauccacggaaccuccugaagaugagacuuugggaagaguuggcccacgauccgcuggacaggaaaugugucuacacaggcgagcagaucucuauugaacgccuccuguccgaugagguggacaucgaucauauuuuacccguagcaaugacucuggacgauagcccugcuaauaagauaaucugcaugcgauaugccaacagacacaagcggaaacagaccccaucggaagccuucgggucuucccccacacuucagggacauagguacaauugggacgauauugcugcacgcgccacugguuugccucguaacaagagauggcgguuugacgcgaaugcuagggaggaguucgauaaacgcggcggguuucucgcccgacaacugaacgagaccggauggcuagcaagacuggccaagcaguaccucggcgcuguuacagacccaaaucagaucugggugguccccggucggcugaccucaaugcuuagggggaaauggggcuugaacggacuguuaccgagugacaauuaugcaggcgugcaggauaaggccgaggaguuccucgcgagcacugacgauauggaauuuuccggggucaaaaaccgcgcugaccacagacaccaugccaucgauggacuggugacggcacuuacagacaggucucuguuguggaagauggccaaugcuuacgaugaagaacacgaaaaguucguuauugagccuccauggcccaccaugcgggacgaucucaaagccgcacuggagaagauggugguaagccauaaaccugaccacggcauagaagguaagcuacaugaggauucagcuuauggguuugucaaaccccuggacgccacuggacucaaggaagaggaggcgggcaaccugguguaccguaaggccaucgaaagucuuaacgagaaugaaguugaccgcauucgagauauccaauugagaaccauugugagggaccacgucaacguggagaaaacaaaggguguagcacuggcugaugccuuacggcagcuccaggcuccauccgacgauuauccucaauucaaacacggccugcgccaugugagaauccuuaagaaagaaaagggggacuaccugguucccauagcaaauagggccagcggagucgccuauaaggcuuacucugcgggcgagaacuucuguguggagguguuugaaaccgcagggggaaaaugggauggcgaggccguccggcgauucgacgcuaauaagaaaaacgccgguccaaagaucgcacacgccccgcaguggagagaugcuaaugaaggggcgaagcuaguuaugcgcauucauaaaggagaccucaucaggcuggaucacgagggccgggcccguauuaugguggugcauagauuggacgcagcugccgguagguuuaagcuggcagaucacaacgaaacuggcaauuuagacaaacgccacgccacaaacaaugacaucgauccuuuccgguggcucauggcuucauacaacacgcugaagaaacuugccgcgguacccguccgaguggacgagcuggggagaguuuggagggugaugccaaauuga

SEQ ID NO: 2863 - RNA, 3507 nt, Artificial Sequence
  Cas9 variant
auggccagacccgcuuucagggcaccucggcgcgagcacgugaacggcuggaccccagacccgcaucgaaucagcaagcccuuuuucauucuggucuccuggcaccuccuuucucguguugugauagauucaaguagcgggugcuuuccuggaacauccagagaccauacugauaaauucgccgaaugggagugugcgguacagccauacaggcugucuuuugacuuggguaccaauucgaucggcuggggguuacugaaccuagaucggcaaggaaagccccgcgaaauuagagcucucggcucaaggaucuucagcgacggucgggauccucaggacaaagccagucuggcaguggcccgccgacuugcuagacagaugaggcggcgucgcgauagauaucugacgaggcggacacgauugaugggggcacucguccgcuuuggacugaugccagccgaccccgcugccagaaagaggcuggagguggcgguugauccuuaccucgcacgggaacgcgccacuagagagagguuagagccauucgaaauuggccgugcucuguuucaccuuaaucagcggcgaggcuauaaaccggugagaaccgccacaaagcccgacgaggaagcagggaaggucaaagaggcuguggagagguuggaagccgcgaucgccgcagcuggagccccuacccugggugcuugguucgccuggcgcaagacucggggcgagacacuaagagcaaggcucgccgggaaaggaaaggaagcugcguacccauuuuaucccgcacgccgaaugcuggaggccgaguucgauacccuuugggcugagcaagcccggcaucacccugaccuguugacggcagaggcccgugaaauacucagacacaggaucuuucaucagcgcccacugaaacccccgccuguaggccggugcacuuuauaccccgacgaugguagagcuccaagggcccugccuuccgcacagcgacuccgccuuuuccaggagcuggcgucuuugcggguuauucaccuagaccugagcgaaagaccccucaccccagcugagagggaucguaucguggccuucguccaagggcggcccccuaaggcaggacgcaagccaggcaaagugcagaaguccgugccguuugaaaaacugagaggccuucuggaguugcccccugggacaggauucucacucgagagugacaagaggccagaacuguuaggugaugagacuggcgcccgaauugcucccgccuuugggccuggauggaccgcacugccacuagaagaacaggacgcucucgucgaacugcuuuugacagaggccgagcccgaacgggcgaucgccgcucugaccgcacgcugggcccucgaugaggcuacggccgcaaaacuggcgggcgccacucuuccggacuuccaugguagauaugggaggcgggcuguugccgaacuguugccugugcucgagcgagagacaagaggcgauccagacggacgcguaaggcccauacgucuggaugaagcagugaaguuacugcggggcgggaaagaccacagcgacuuuucuagagagggagcucuacucgaugcccugccuuacuacggugcaguccuugaaaggcacguggccuucggcaccgggaaccccgcugacccagaggaaaagcgcguuggacgaguggcgaauccuacuguccauauugccuugaaccagcugagacaccucgugaaugcaauccuggcucggcauggcaggcccgaggagauuguaaucgaauuagcccgcgaucugaagcguuccgccgaggacagacggagggaagauaaacgccaagcugacaaccagaagcgaaaugaggaaagaaaacggcuuaucuugucacucggugagaggccaacaccgcgcaaccugcuaaagcugagacucugggaggaacaggggccuguugagaauaggcggugucccuauagcggcgaaaccauuaguaugcguaugcugcuuucugagcaaguggauauagaccacaucuugccauuuuccgucagccuggaugacucggcagccaacaaaguggucugcuuacgcgaagcgaaucgaauuaagagaaacaggucucccugggaggcuuucggacaugauuccgagcggugggccggcauccucgcacgcgccgaagcucugccuaagaauaaaagauggagguuugcaccagacgcccuugagaagcuggaaggggagggagguuugcgggcgcgacaccucaacgauacgagacaccugucacgccuagcuguggaguaccugagguguguuugccccaaagugcggguaaguccuggccgucucaccgcccugcuuagaaggcgcugggggauagacgcaauuuuggccgaagcugacggaccgccacccgaggucccugccgaaacacuggauccaagccccgcagagaagaaccgggcugaccaucgacaccaugccuuagaugcggugguuaucggcuguaucgacagauccauggugcagaggguccagcucgccgcagcuucugccgaacgcgaggcugcagcccgggaggauaauauuagacgugugcuggaagguuucaaagaggaaccuugggacggguuuagggccgagcuugaacggcgcgcucgaacuaucguagugagccacagaccggagcacggcauuggaggcgcgcugcauaaggagaccgcauaugggcccguugauccaccugaagagggauucaaccuagucgugaggaagcccauagacggccucucaaaagaugaaaucaauagugugcgggacccacgccugagaagggccuugauugaucgacuggcuauccggcguagagacgccaacgauccugcaacagccuuagcuaaggcggccgaggaccucgcagcucagcccgccucccgcgguaucaggcgggucagaguucugaaaaaggaaagcaauccaauucgcguggagcacgggggaaacccgucuggcccuaggucagguggccccuuucauaaacuucuguuggcaggggaggugcaccauguagacgucgcccuccgagcugauggacggagaugggugggccacuggguuacucuguucgaagcccacgggggaaggggcgcggacggugcagccgcuccaccccgccuaggggauggagagcguuuccugaugcggcuucauaagggcgacugccucaagcuggaacacaaagguagagugagggucaugcaagugguuaaguuggagccuaguagcaauuccgugguagucguggagccacaucaggugaaaaccgaucgcucuaagcacgucaaaauaucgugugaccagcugcgagcccggggcgcuagaaggguuacaguggaucccuuagggcgcguaagagugcaugcaccuggagcccgggucggcaucgggggagacgcuggcaggaccgccauggaaccggcagaggauauuagcuga

SEQ ID NO: 2864 - RNA, 3513 nt, Artificial Sequence
  Cas9 variant
augagcaaguacaacgugggccuggacaucgggauugccuccgucggauggucuauaguugaugcugacaaaaagaaaaucauugaucucgguucaagaaucuucaguagcggcaaugcagccgcgaaccaggagaggcggggguuucgcggaacccgacgucuuauuagaaggcggaagaaucgccugacagacgugaucaacuucuuuggcgaaaagaaguucauagauacuaagguaguggacaaaaauggucacguccauuauaaguuuuccgugaacaauacggagucucccuacgaauugagaguuaaaggguuaucggagauccugaccaagcaagagcuagugauugcucucuaucacaucgucaaacauaggggaauuucauacgaucugggcgaccuugaagaugacggcacaagcggggugacugauuauaagaccaguaucaacauaaaucggcagcuguugaacgagaagacaguaggacagauucagcucgaacgccugaaugaguucgguaaaguucgaggccaaguggaagagaacgagaaugucacccugcucaacguguuuccuuccgccgcauacgugaaggaagccacucagaucuuaacaaaacagagagaguucuauccagaaauuaccgacgauuuuaucgcuaaguucaugcuguuuaucacgaggaaacgggacuacuucgucgggccgggaaaugagaagucucguacugacuacggcauuuauaaaaaggauggucgcacccuugacaacuuguuugaugaacugauagggaucgacaagauuaacggagagaaaagagcaagcgccuccucacuaacagcucagaucuacaauaugcucaacgaucugaauaaccuuacuguucccaauaccgaggacggcaggcugacaauacaaaccaagaaagaaauuuuggaggccgcgaagacgacuaacggccucuucgggaucgcacagaucugcaaaauuaucggauguaagaaggaugacauuaaagguuuccggauagauaagagugagaaaaagaucaugcacacacugagcggcuaucgaaaauuucgcaaggaauuagccgacgugaauauugaagcuaacgaucugaauaucaaccucguaaauaagaucgccgacauucuuacccugaacacugagaaagcagagauaagaaagcaguuggacaaaucuaauauggauaucuccaacgaaaugaaggagauugugaucaauaaaaacaaggaguuccuagucgacgggagggcuacauggcauucauuuagcuacaagacccugaaccuccugauuccugaacuucugaauacgccagaggaacagaugaccaucuugacacggcucggacuggugaaacccaacaauaagaaauaugagggcuuaaagaacauaccugcccgcagaaucacugaagagauuuacaauccaguuguggcgagggccacccgugaagcagucaacguguucaaugcuaucacuaaaaagguaggucgggauaacauuaaagacguuaucauagagcugccccgagaggauaaugaaguggacauuaagaaggggaucgucaaaagacaaaagcagaacgagguggaaaaagagacugccgaugcucuagucaagcagcacaugaccauuagugacucugcccucaucgcacaauauaggaaaauacgcggccugucccagaaggugcgguacugguaccagcaggauacaaucugcccuuauuguggaaagaaaauugaagccguucaacuuaucaauaacaaugacagcuuugagguggaucacauuguaccaaucucggucucuuucgacgauucccagaacaauaagguguugguucauucacagugcaaccaggcuaaagagaagcaaaccccgcugggcuggcucaacaaugggggagguuuuggccagaguaaagcggacuacauagcaagagucaagagcaacaagaauuaugccaaaaacaagauugacaaucugcuuaacgaaacugaucugaaugacaucgcuacgcagaggggguucauccagcgcaacuugaaugauacacgauacgccucccggauugugcucaacgaguuuuauucuuucuuucguagcaauaaccugucaaccaaagugaagguagugagaggaaaauggacuucacaaaugaggaagaaguggaauggcguugguggguuauccaaaacccgcgacacauaccaccaucacgcaaucgaugccuguauuauagcuugcuucccccugcuaaaggccuuugacaaagcaaucaagcucauugaugucgacggcgaaaccggagagauccugcaggauaaaaaggcgauuaaacuugcucaggaagccgagaucguggagaagauaagcgugaucaagaacaaaaaguucgaaaauauggucaacgagauuuauaacuucccuuuguuuaaacagguugaacuggcaaaugacaucacuaaccucgagaauccagugaaguucucucaccauguggauaaaaaggccaaccgggcuguagccaaucaaacaauuuacggcacgagaaucaaggaaaaagaggucaccaagagggggaaaaaggagaaaauacaggaacgauacacucugggaacaauuaagaacaucuaugacaucgaugguuuuaugaauuucaagaaauuauacgacaagauuaguaaaaacgacgaugugaaguuucugaugcagaaaaaugaccccaagaccugggagaaacuuauagauaucuucaacaguuauccugacagcgaagagguuacacaaguggauggcaaagucaagcgcguggcaguuuccccauuuaaauuguacuaucgggagaauggguucauuacuaaguacucuaaacacaacgacggacccaaggugguaucgaucaaguauuacgauagcaaagucggcucccauauugacaucaccccgaaggaugcuagaaauaaagugauacuccagucacugaagccuuggaggacggacguguacuuuaacaguaucacccagcaguaugaacuacugggucucaaauacucugaucugaaguucacaaauggggucuauggcauuacucgugacgccuacgagaaacuuaagcacggaguuagcgaagacggcgugaccgcguggaagcccaucuccaaaaacucagaguuucgcuucagcuuguaucggaaugauagaguaagggugauugacgaaaagggggauucuaucgagcuguuauuugccucccgaacaacaaguaacgagggauacgucgaacucaaaccaauauauaaggcuaaauucgacagcaaggaggaagugggcuucuacggucugguuucuaacgggcggcuuauuaagaaaauguccaagggaggcuacaaacuguauaaggugaauaccgauaucuuggguaaaccuuacuaugucacgcgcgagucagacgaacccaagcucagucuguga

SEQ ID NO: 2865 - RNA, 3516 nt, Artificial Sequence
  Cas9 variant
auggccaaguacagcgugggccuggacaucgggauuuccucugucggaugggcuauaaucgauauugagaccaaacagaucguuaaccucgguucaagaauuuuccccaguggcaaugcagccgggaaccaagaaaggcggggauuucgcggcauccgacgucuuauaagaaggcggaagaaucgccugacagacuugaaaaaguuacugggugagacuuucuuuagcgaucucaaaaagaucgacuccaacggguaugaauacuaugauauugacuuccagaucaaugcgaacccuuacgagcuaagagugaagggaauuacggaaaaacugucuaagaaagagcuugcuguagugcugcaccauaucauaaagcacaggggcauuucguaugauuugggcgaccucgaggaugacgggaccucaggagucagcgauuacaaaaauaguaucaacauuaaucggcagcugcugcgcgaaaagacagugggucagauccaacucgagcgauuaaucgaauuuaaccagguucauggccaggugaagaaagccgaggacgucucccugcuuaauguguucccaucuagcgcauauagagaugaggccaacaagauuaugauaaaacagcaagaauuuuacuccgagaucacuaauucauucauggaacagguagaccaguugguuaguaggaagcgggacuacuuuauugggccgggaaacgagaaaagccguaccgauuauggcaucuacaagucugacggucgcacacuggauaaucuauucgcugaacucauagggaccgacaaaauuaacggagagaagagagcauccgccucaagccugacugcucagguguauaaccuucugaaugauuugaacaaucuccacgucaguaacacagaggacggcaagcugaccacgucuacuaaaaaggaaaucaucaaagccgcgaagaccacagauggcguguuugggauuucccaaaucugcaaaauuauaggauguaagaaggaggaaaucacugguuucaggcaggacaaaagcgagaagaaagugauucauaccuuagcaggcuaccggaagauccgaaaagcccuggcuacaaucaauauugaagccaacgagcucaaucccaccgucuuugaucagauagcagacauccuuacgcugaacacugagaaggcugaaauucgcaagcaauuggauaaaguucagcuagacaucacagacgagaugaaggaacuggugauugauaaaaauaaggacuuccucguagaugggagagccaccuggcacucguucucuuaucagacucugaacaugcuuaucccugagcuguugaauacauccgaagaacagaugaccauacucacgaggaugggacugaugaaaucagacaacgagaaguaccggggcuuaaagaaaaucccagcggaaaagauugccagugagaucuuuaaucccguggucgcaaaaagcacccgcgaagcuauuaagguguucaacgccaucuccaaagagauagguaagaauaacauugagcacguugugaucgaacugccuagagaugacaacgaggaagaugagaaaaggaagauucaaaagcuacagaaagcuaaugaaacagagaaggaggccgcagacaaccucgucaaacauaagcuggggaucucugauagcgcccuuauagcucacuaucguaaauuuaagggcuugucacagaaggugcgguacugguaccagcaagaaacuuauugcccauacuguggaaaaaucauugaggcgacccagcugaucaauaacaaugacaacuucgaaguagaucauauuauccccauaaguguuuccuaugacgauagccagaauaacaaggugcucguccacucucagugcaaucaagcaaaagagaagcagacaccucugggcuggauuaacaaugggggagguuuuggccagagcaaaaacgaauacacuaaucgagugaagaacaauaagaaauauaguaagaacaaagucgacaaccuucugaaugagaccgacuugacagauaucaucacccagagaucauucauucaaaggaaccucaaugacacucgcuacgccgcucggacggugcuggaugaguuuuauuccuucuuuaagucuaacgacuuaccaacaaaaguuaaggugguaagagggaaguggaccucgcagaugaggcgcaaauggaauaacgucggaggccugcgaaagacucgggauacccaccaucaccaugccaucgacgcaagcauuauagccuccuucccgcuacuccgugcuuuugauagagccaucaaacugauugacguggauaaggaaacaggugagaucguucaguacgggaaagcaucacuuaauggcgacgugauugaagagaagagugucauccaagcgcccauaaucaaaaacgaaaaguucgagaaguugguggaugagauuuacaauuuuccucuguucaaacagguagaacucgcuaacaauaucgagaacccagaaaaucccgugaaguucucucaccauguugacaaaaaggccaacaggaccgucgcaaaucagacuauuuauagcacacgcaucaaaaagacggagaagauagugcggaaaaaggugaccgccaaagaggaagaguacgucauuggaacuaucaaggauaucuaugacguuacaaacuuugaaaaauucaagaagcuguacgacgaguccagcaaaaaggaugacauuaaauuuuuaaugcagaagaacgauccuaaaaccugggaaaagcugguggagauaaugaauacauauccagacuacgaggaaaucucacaacuugauggcaaggugaaaagaguaaaggucucucccuucaaauuguauuuuagggagaacggguucauuacuaaguacgcuaaacacaauaacggaccgaaggugguuuccaucaaguacuaugacaguaaacucgguaaucacauugauaucaccccugugaacgccaauaacaaggucauacugcagagccuaaaacccuggcgaacggacguguacuauaauaacgaaacccagcaguacgagcugcucggccugaaguauucugaucuuaaauuuacaaaggggguuuacggaaucacucgcgaagcauaugagaaauugaaguacggcuacaccgacggugugccagcuuggaagccuauuuccaaagagucagaguucaaguuuagucuguaucggaaugauagaguaaggaucauuaacgaggccggggagaaaaucgacuuacucuucggcagccguaaugaaacaucggaaggauacgucgagaugaagcccauauuuaaaacuaacuucgacgaugcggaggaagccuccuuuuauggcaagaccucuaauaagcgccugauuaaaaagauggcucggaaaggguaccaaaucuauaaggugaacacggacauccuuggaaaucuguacuauacagcaaaagagagcaacgaaccaaaguuggaucucuga

SEQ ID NO: 2866 - RNA, 3519 nt, Artificial Sequence
  Cas9 variant
augagaaagcccuacagcaucggccuggacauugggaccaacuccgugggaugggccgucauaacagaugacuauaaaguuccuucuaagaaaaugaggauccaggguacuacggaucggaccucaauuaagaaaaaucucaucggcgcacuucuguucgacaacggggagacagcugaagccacucgcuugaagcgaaccacacguagaagguacacccggcgcaaguauagaauuaaagaguuacaaaagaucuuuaguagcgaaaugaaugagcuggauauagcguucuuuccaaggcuauccgaaucuuuccucgugucggacgauaaagaguuugagaaccacccgaucuucggaaaucugaaggacgaaauuacuuaccauaacgauuaucccacaaucuaccaccuucggcagacccuggcugacucagaucagaaagccgacuugcgccucauuuaucuggcacuggcccauaucauaaaguuucgaggccacuuccucauugaggguaauuuagauagcgaaaacacggacguacaugugcuguuucuuaauuuggucaacaucuacaauaaccuguucgaggaggacauuguggaaacugcuaguaucgaugcagagaagauccuaaccuccaaaacaucuaagagcagaaggcucgaaaaucugauugccgagauaccuaaccagaaacggaauaugcuuuuugggaaccugguuuccuuggcucucggacugacuccaaacuucaagaccaauuuugaauuacuggaggacgccaaacuccaaaucucaaaggauaguuacgaggaagaccuugauaaccuguuggcgcagauuggcgaccaguaugcagaucuauucaucgccgcuaaaaagcugagcgacgccauacuccugucugauauuaucacagugaagggcgcauccaccaaagcuccccuuucagccagcaugguccagcguuacgaggaacaccaacaggaccuggcguugcucaagaaucuggugaaaaagcagaucccugagaaauauaaggaaauuuucgauaacaaggagaaaaauggguacgccggauauaucgacgguaagacgagucaggaggaauuuuacaaauauauuaagccaauauuacugaaacuagacggcacugagaagcucaucucuaagcuggaacgcgaggauuuccuuagaaaacaaaggacauuugacaacggguccauuccccaccagauccauuugaaugaacugaaggcaaucauucggcgacaggagaaauucuacccuuuucucaaggagaaccaaaagaagauagaaaagcuguucaccuuuaaaaucccauacuauguaggaccgcuugcuaauggccagagcucguucgccuggcugaagcgccagucuaacgaguccauuacucccuggaauuuugaagagguuguggaucaggaggcuucagccagagcauucaucgaaaggaugacaaacuuugacaccuacuugccugaggaaaaaguccucccaaagcacaguccccuguaugagauguucaugguguacaaugaauuaacgaaagugaaguaucaaaccgaggguaugaaacggccugucuuucugagcuccgaggauaaggaagagauuguuaaccuacucuucaagaaagaacgcaaggugacaguaaaacagcugaaggaggaauacuucucuaaaaugaagugcuuucauacugugaccauccuuggggucgaggacagauucaaugccagcuugggaacauaucacgaucugcucaagauauuuaaagacaaggcuuuccuggaugacgaggcgaaccaggauaucuuagaagagauuguguggacucugacccuuuuugaagaccaggcaaugaucgagaggcguuugguuaaauacgccgauguguucgaaaagucaguccucaaaaagcugaagaaacggcacuacacaggcuggggccgacuaagucaaaagcugauuaacgggaucaaagacaagcagaccggaaaaacuauacucgguuuucugaaggacgauggcguggcuaauagaaacuucaugcagcuuauuaaugacuccagcuuggauuuugccaagaucauuaaaaacgagcaggagaagacgaucaaaaaugaaucucuggaggaaacaauagcaaacuuagccgggucaccagcuaucaagaaaggcauucuccaaaguaucaagauuguagacgagaucguuaaaauaaugggacagaaucccgauaacauugugaucgagauggccagggaaaaucagagcaccaugcaggguaucaagaacucccgccaacggcugagaaaacuugaggaaguccauaaaaauacugggucuaagauucugaaagaguauaacgugucgaauacccaguugcagagcgacaggcucuaccuguaucuacugcaagauggcaaggacauguacacaggaaaagaacucgauuaugacaaccugucccaguacgauaucgaccacauuauaccgcagucauucaucaaggauaauaguauugacaacaccguccuuacuacacaggcaucuaaccgcggcaagagcgacaaugugccuaacaucgagacgguuaauaaaaugaaguccuuuugguauaaacaauugaagucaggggcgauuagccagcgaaaauucgaucaucugaccaaggcugagcggggagccuuaucugacuuugauaaggcagguuucaucaaacgucagcucguggaaacuagacagauaacaaagcacguagcccaaauccuggacuccagguucaacaguaaucuuaccgaggauagcaaaucuaaccgcaaugucaagauuaucacacugaaauccaagauggugucagacuuucggaaggauuucggcuuuuacaaacuaagagaaguuaacgacuaccaucacgcucaggaugccuaucucaaugcaguggucgggacugcucuguugaagaaauaccccaagcuggaggccgaauuuguguauggagacuacaaacacuaugauuuagcgaagcucaugauucagccagacaguagccugggcaaggccaccacgaggauguuuuucuacucgaaccuuaugaauuucuucaaaaaggagaucaaacuggcugacgauaccauauuuacacgaccucagauugagguaaacacugaaaccggugagaucgugugggacaagguuaaagauaugcaaacaauccgcaaggucauguccuauccccaggugaauauugugaugaaaacugaaguccagaccgggggcuucucuaaggagagcauauggccaaagggagacucagauaaauugaucgcacggaagaaaaguugggaccccaagaaauacggcggguuugauuccccuauuaucgccuacucuguucucgugguggcuaagaacuguaagaggaaaaauagcaagacgaaaaacuaucaaagaacaugcggaaacaagaauaacgguacccguuga

SEQ ID NO: 2867 - RNA, 3522 nt, Artificial Sequence
  Cas9 variant
augagacccaucgagccuuggauucugggccucgacauagggaccgauagccuuggaugggccguguucuccugcgaagagaaggguccaccgacagcuaaagaacuguugggcgggggagucagguuauuugacucuggccgggaugcaaaggaccacacuucacgccaggccgagcgaggugcguuccguagagcuaggcggcaaacgcgcaccuggcccuggagaagggaucggcugaucgcccuauuucaggcagccgggcucacaccuccagcugcagaaacucgccagauugcccuggcccuucgaagagaggcuguuaguaggccccuggcgccugacgcauugugggccgcucuccugcaucuggcccaccaucggggauuccguagcaaccgcaucgauaaaagagagagggcagcugccaaggcgcucgccaaagcaaagccagcuaaggccaccgcuaaagccacagcacccgccaaggaagcugacgaugaggcgggcuuuugggaaggcgcagaggccgcuuuacggcagcgaauggccgcauccggggccccuaccgugggagcucugcuugccgacgauuuggaccgcggucaaccaguaagaaugagguacaaucagucugaucgggacggcguggucgcaccgacucgcgcgcugauugcugaggaacuagccgagaucguggcaagacagucgucagccuaucccgggcucgacuggccugcuguuacaaggcuggugcuugaucagcguccacugcggagcaaaggagccggccccugugcauucuugccuggugaagaccgagcucucagagcccugccaaccguccaagauuuuauaaucaggcagacguuagcgaaccugcgccuccccaguacuuccgccgacgagccgcggccucuuaccgaugaggaacacgcuaaggcacuggccuugcuaucuacagcuagauucguggaguggcccgcccugaggcgcgcacucgggcugaaacgaggaguaaaguuuacugcggaaaccgagcggaauggcgccaagcaggcugcccguggcacagcagggaaccuuaccgaagcuauucuggccccauugaucccuggauggagcgguugggaccucgauagaaaagacaggguuuucuccgaucugugggcagcccgccaggaccggucagcuuuacuggcgcuaauuggcgaucccagagggccaacgagggugacugaggacgaaacagccgaggcagucgcugacgccauccaaauagugcuccccaccggacgagccagucugagcgcuaaggcagcccgcgcgauugcucaggccauggcaccuggcaucgguuacgaugaggccgugacucuugcuuuggggcugcaucacucucaccggccaagacaggaaaggcucgcacgucugccguauuacgccgcggcccuucccgacgucggccuggauggagacccuguuggcccacccccugcugaggaugacggggcagccgcugaagccuauuacggacgcauugguaauaucuccgugcauaucgcauugaacgagacacggaaaauuguaaaugcucuccugcacagacauggcccaauauuaaggcuggugauggucgaaaccacgcgagagcuaaaggccggggcggaugagcggaaacgcaugaucgccgaacaagcagagagagaaagggagaacgcugagauugacguggaacuccggaagucagaucgauggauggccaaugcuagagagcgcaggcagcguguucggcuggcaagaaggcagaacaaucuuugccccuauaccagcacaccgaucggacacgccgacuugcugggcgaugccuacgacauagaucacgugauuccucucgcucgcggugggcgagacagucuggacaacauggucuuaugucagucugaugcgaauaaaacuaagggcgacaagaccccaugggaagcauuucaugauaaacccggauggaucgcccaaagagacgauuuccuggcucggcuugacccucagacagccaaggcauuggccuggagguuugcugaugacgcgggcgagcgcguggcccguaaauccgcagaagaugaggaccagggguuccuccccagacagcugacugauaccggauacaucgcucggguagcccuaagguaucugagccucguuacaaacgagccaaaugcaguggucgccaccaacggucgccugacuggccuuuugcgacuggcuugggacauuacgccugggcccgccccaagagauuuacucccgacaccucgggacgcgcugagggacgauaccgcagcccgcagauuccuugacggacugacucccccacccuuggcuaaggccguggaaggcgcuguccaagcaaggcucgccgcucugggucggucgcguguggccgaugcagggcuagcggacgcccugggccucacccuggcuucucuuggaggcgggggaaagaaccgcgccgaucaccgacaucacuuuaucgacgcagcuaugauugccguuacaaccagaggcuugauaaaucagaucaaccaggcauccggugccgggaggauucuggauuuacggaaguggccucgcacuaauuucgagccacccuacccuacauuuagagcugaagugaugaagcagugggaccauauccacccgucaaucaggccagcgcaccgggauggaggcagucuccaugccgcaacgguauucgguguccgaaacagacccgacgcucgcgugcugguucaaaggaaaccuguggagaaacuuuuucuggaugccaaugccaaaccacuacccgcagacaagauugcugaaauaaucgacggcuucgccagcccucggauggcgaaacguuuuaaggcucuccuggccagauaucaggcagcccacccggaggugcccccagcuuuggcagcccuggcggucgcuagggauccugccuucgggccccgcggaaugaccgcaaacacuguaauugccggccgguccgacggggauggagaggacgcuggcuuaaucacaccauuucgagccaauccuaaggcagcugugagaaccauggguaacgccguuuacgaagucugggagauucaggugaaagggaggccccgcuggacacaucgggugcucacuagauucgaucguacccagccagcgccgccucccccacccgaaaaugccaggcuggucaugcggcuucgccgaggagaccugguuuauuggccuuuggagucuggcgauagacucuuucuggugaagaaaauggcaguggacgguaggcuagcucuguggccagcccggcuugcaacgggcaaggcuaccgcccucuacgcccaacugagcugccccaacaucaauuugaacggggaucagggauauuguguacagucagcggaaggcauacgcaaagagaagaucagaacaaccaguugcacugcucuggggagguuacgacucuccaagaaagcaacauga

SEQ ID NO: 2868 - RNA, 3525 nt, Artificial Sequence
  Cas9 variant
augggcaaguacagcaucgggcuggacauuggaauauccucuguggguuggucaaucauugauaucgagaaaaagaaaauugucgaccucggcaguagaaucuuccccagcgggaacgccgcugcaaaucaggauaggcggggauaucgcggcacccgacgucuuauaagaaggcggaagaaccgccuggccgacguuaucaacuuuuugggugaagagaauuucauugauacaaaagugguagaccaaaaugggaacauccacuacaaguuacugguaaauuccacugaaucuccuuauaagcuaagagucaaaggacucucgaagaugcugacgaaacaggagcuugugauugcgcuguaccauaucguuaagcacaggggcauaucauaugauuugggcgaccucgaagaugacgggaccagcggagugacagauuacaaaaccaguauuaacaucaaucggcagcugcugauuaagaagacugucggucagauccaacucgagcgcuuaaaagaguuuggcaaggugcgagggcaugugaaaaaggacgaaaacaucacacugcuuaauguuuucccauccucugcuuaugugaaagaggccacccagauuuugacuaagcagagagaauuuuacccggagauaacagaugacuucaucaccaaauuuauucccuucaucagcaggaagcgggacuacuuugucggaccuggcaacgagaagucccguacggauuaugguauauacaaaaaggacgggcgcacucuggauaaucuauucgacgaacucauuggaaucgauaaaaucucaggcgagaagagagcaagugccagcucugugaccgcucagauuuauaacaugcugaaugaccuuaacaaccugacagugacuaauaccgaagauggcaaauugacaacccaaacgaagagggagaucauugaagcagacaagacuacaaacgggcucuuuggaauaacccagaucugcaaaauuaucgguuguaagaaagaugacaucaagggcuuccggauugauaaagucgagaagccaauaaugcacacucuguccggguaccgacgcuuuagaaaggaguuagccaaaaucaauauugaagcuaacgaccuggacaucaaucucguuaacaagauugccgauauccuuacacugaauaccgagaaagcggaaauaaggaagcaguugaacaaaucaaauaucgacgugagcaacgagauuaaggaacuaaucauuaauaagaacaaagauuuccugguagacggacgggcaacguggcauaguuucucuuauaagacccucaaucugcuuauccccgagcugaugaacacauccgaggaacagauaacuauuuugacccgccucggccuggugaaaagcaauucggagaaguacaaagguuuaaagaacaucccugccagaaggauuacagaagggaucuauaacccagucguggcuaaagccacucgugaggcaguuaauguguuuaacgcuauagccaagaagaucggccgggauaauauuucugacgucgugaucgaacugccccgagaggauaacgaggcggacauuaaaaagggaaucguaaaaagacaaaagcagaaugaacuagagaaagaagccgcagaugcucucguuaagcagcaaaugaccauauccgacucagcccugguggcucacuacaggaagguccgcggccuuagucagaaagugcgguacugguaucagcaggggacaugcuguccuuacugcggaaagaacauugaggccguccaauugaucaauaacaaugauagcuucgagguggaccacaucauuccaaucuccguuucuuuugaugacagccagaacaauaaagugcugguacauucacaguguaaccaggcaaaggguaaacaaaccccgcucggcuggcugaauaacgggggaggcuucggucagaauaagacugaauaugucgccaaggugaaaacgaacaagaacuacaguaaaaauaagauggacaaccuucugaaugauauggacuuguccgauauuguuacacagagaggguuuauacagaggaaccucaaugacacccgcuaugcuagccgaaucgugcuggaugaguucuacucauuuuucaaaucuaacaauuuaaguacuaaggucaagauugugcggggcaaauggaccagccaaaugcguaagaaauggaacggaguaggcgggcugaagaaaacaagagacaccuaucaccaucacgcgaucgaugcauccauuaucgccucuuuuccccuacucaagguguucgacaaagcuauaaagcugaucgauauugacagggaaacuggagagauccuucaggauaaggaagccauuaaaaugucgcaggaggcaaaguugcuggagaaaaucccuguuauacagaaugaaaaguuugaggaacucauuaacgagcuguacgacuucccauuauuuaaacaagucgaacuggccaaugauaucacaaaccccgagaauccugugaaguucagccaccauguggacaagaaagcuaaccgcuccgucgccaaucagacgaucuacgguacccggauuaaggagaaagaaauaaacaagagaggcaaaguugagaaggugcaggaaagguauauccuugggacuauuaagaacaucuacgacauugauucauucacaaguuuuaaaaagaucuaugacaaaaugucuaagaccggagaugugaaauucuugaugcaaaagaaggacccaaaaacauggggcaagcucguagagauacugaauagcuaccccgauuccgaagagaucacucaggucgacgguaaagugaagcgaguuaaagugucaccguuugagcuauaucgccgggaaaacgauuucauuaccaaguacgcaaagcacaaugacgggccuaaaaucgucagcauuaaguauuacgauucuaaaaucggcucccauauagacauuacgcccaucaacgcgaagaauaaagugguucugcagagucucaagccauggagaaccgauguguacuuuaacagcgagacaaggcaguaugaacugcuuggauugaaauacucugaccugaaguucacuaauggcguauaugggaucaccuccgaggcuuacgagaaguuaaaacacggaauuucagaagacggcacaaagacuuggaaaccuaucgguaagaacaguggguuucguuucagccucuaucgcaauaaccgggucaaaauaguggaugagaagggagaaucgcuggagcuucuguuugccuccagaaccacgucuaaugaaggcuacguggaguugaagcccauuuauaaaagcaaguucgacucaaaagaggaugucgguuuuuacggccaaaugacaccaagugggcaguucguuaagaaaauggcaagggugggauacaagcucuauaagguaaacaccgacgugcugggcaaucccuacuauaucacuaaagaauccgaugacccugagcuaucucuguacaagaaauga

SEQ ID NO: 2869 - RNA, 3528 nt, Artificial Sequence
  Cas9 variant
auggaggaaaugaagcagaccggcagaaagaacgaggcccccaagcugacagaccucaauuacaggaucgggcuugauauuggaauagcuagcguggguugggcaguccuggaaaacaauucccacgacgagccuuuccggaucauugauuugggcguucgcaucuuugacacugccgaacaaccaaaaacgggggcgucuuuagcucugccgcgacgugaggccagaucagcaaggcggcgcauuagaaggcggcgcgaucgaaucgagagaauaaagaaacuauuccaggccgaaggacucaucaacauugacgaguuugaagcuagguauaagaucgcaggccugagugauguguacaaacuucgguaugagggucuggaccguaaauugaccgaugacgagcucgcccagguacugcugcauauugcuaagcaccgcggguucaaaagcacauccaaggccgaagaggcggaaaaugagaacgaugcagccaaaaagaaggaagcuggagcccucaaaaagggcaucucuaauaacaaaaaguuaauggaggagaaaggcuacagaacugugggggaaaugauguaucuggacgagaauuuuaggaccgauugccccuggaacgaaaauggauacauacuuacaccucggaacaagucgggugacuauaaacauaccgucuugcgagacaugcugguggaugagguucgcgaaauuuucaagucacagagaagccuaggcaauauccacgcaagugaggagcucgaaaacgcuuaccuggacauuaugcuuucccaaaggucuuuugauauggggccaggagcccccagcaaguacgcgauggagggcuucgaagaccgggugggucuguguacuuuugaggggaaaaauggagaaaagcgcgccgcaaaagcugccuauacauccgaguuguucgucgcucucgagaagaucaaccauaccaaaaucgugucagaugacggcgccacgagauuucugacuaccuacgaaaggaagaguauuauagaguuaaugcacaagcagcagacaguaaaauaugcagccguucguaaggcuaucggccuggcggaagaggauaaauucuacaaccucaauuauagcccuaaggcagggucuaaaaaguccccagaggacacugauuuugugaaacuugaaaacuaccacaaaauucggaaggcccugggagaggacaucgucucagaacauuugcccgcugagaaaauaaagcuauaugauagcauugccaccauccugacacucuucaaaaaugacgacagucgaaucaagagauucauugaacuggguaucggcgaggagugcuuugaugggcuucugucuuuguccccuagcaaguuccacaaccucucgcugguggcaaugggaaaaauuauaccauuuuuacuggacggcaauaccuacgauaaggccugugaacuagcugguuacgacuucaaagccgauaacaagggggagaaaucugugcuccugaagggcaaaaauaucacggacauggucaacgauauuacuaauccgguugugaggcgcuccguaucacagacaaucaaggugaucaacgcaauuauacuugaauauggaaguccccaagcggucaauaucgaguuggcucgggaaaugagcaagaacuuugacgagagaaggaaacugaaguccgauauggagucucgcgaaaaagagaauaacaaugugauuaagcgaguuaaagaauacaagcucaacccuaccggccaggacaucgugaaguuccggcugugggaggaacaggaucguagaugccuuuauagcggggagaaaauugacaucaacgaucuguuuucaagggacggagguuacgacgucgaucauauauugccauauaguaucacuuucgacgauacauaccgcaauaaggugcucguaaaagccuccgagaaccggcagaagggcaauagaacccccuaugaauacuuuauggcagagaaagacgaugacgaauggaacguuuacgagacgcuggugaggaauaccgucaaggauuauaagaaaguguuaaagcugcucaaaaagcacauuacagaggacgaaaagagcgaguuccgagaacgcaaccuaacugauaccaaguacaucacacggauuaucuauaauaugauaagacaaaaccugguccuuaagccuuacuugucucuggagaaagaaaggaagaaacaggugauggccguuaaugggucaauuacucacuaucucaguaagcguuggggacuggagagcaaagaccgccggaccgauacacaucacgcucaggacgccgugguaaucgcauguaccacugauggcaugauuaacaagaucuccagauacucuaaagguagggaguuacuguauucgcgaggguuuaaguucgucgacgaagagacgggcgaaauacuuagccgggacaauuuuacacgcgaggaaugggaugagaaguacggagugaaaaucccaauucccugggagcauuucagagacgaauuggauaucaggaugucccgguacaacggcaccggggacgauucaauugacaagacuaccccgcgagauuucauccucagucacagagacgcucauaaauggauaaauuauccugaguggauguuuguugaaggacgccccgguaggcguggcgugcuggaugggauuuucgucucucggaugccaaagcacaaagugagcggacaagcccacgaggaaacaguaagauccgcgaaguacuauaacgacggcgguucaguguuugagagcgggggcuacguugucaccaagaaaucuauccaggauaucaagcuaaaagacggagagauuaaggaguucuuuaauccugacuccgauaggcugcucuauaacgcccugguggaccgccuuaacaaauucgaaaaugaucccaagaaggcuuuugcagaaccauucuacaaacccaaggccgacggcacucaggggccuaucgugaaaaagauuaaagucuuugagaagcagaguagcggaguuuucgugcgagauggcaaggguauagcugccaacggggcaauggugagaaucgacguauuuugcgaggaagauaaaggaaagaaaaaguauuacuucgucccaauuuacacagcggacgugguuaaaaagaaguugccggaucgggccgcuacggccaauaaacugaucucugaguggagggugaugaaggaagagaacuuuauuuucuccuuauauucacgcgaccucaucuacauagaaagugauaaaggcguccaagugaaggacaucgaugguaaaauuagcaagcccguuaaucuguucgcauauuaccuuggcgcugacaccucgacugccuccaucucugggaaacugcaugacagcucagcaaacuuucguaguauuggaauccagggcuugagacgguucgauaagugucagguggacguacucgggaauauauccuuugucaacaaggagaaaaggaugccuuucaauuga

SEQ ID NO: 2870 - RNA, 3531 nt, Artificial Sequence
  Cas9 variant
augaacaaggugcaggaggacugcuacaaaaagaucaaagaaaagcuggccgauagagaguauaggauuggccucgaccuuggggucggaagcauagguuacgcuguugugucccugaaaggcgauaugcccgaagacguaaucuuggcagggucucggauuuucaagucaaguaucggagccgcggagcgccgacacuuucgugcucaaagaaauacccauaggcaccaucgggaacgcaugagauauuuauggaagcugcuagccgagaaaaaccucgcacugcagcuuccugagaaucugagcaagaaagaaaacuucacagauuuugacacuuccaggaagcgguucccaauugagguguugcgcaaugauccguacauccuccgauauaaagcccuggacgaaaagcugucucucuuucaguuaggcuacgcucuguaucacauagcaaaccauagagguacggccucggucaggucauuccuugaggaugacgaggcuaaggugaaagaaaauaaggagaccgccaaauuggcgaagaacacaaagaagaucauguacgagaaaaaguaccggacuuuuggggaauaucuguaccgugaacgcauugagaaguucagacagaaugagaggaugaaaguuaccaacaagaaugaaaacaaagaguuugcagugacacgggauaucauugaaaaggaggucgaaaugauccuaggagcccaaaaacgauauaauaccgcugugcucgccgacgauuacauagagcgcauuaagaaggcaaucuucuaugagacugaaaaacugauucccgagccugaauacuguccauauuuuaaggacgacaaaagacuucccaggagccacaagcugaacgaguaccggcgcaucuacgaggcuuugaauaacacaagauauuacaucccugaaauugaggagaaaaccggcgaaauacucaguaggaaggaaaaggagcagcuguccaaagaggaaaaggagaaauuauucaacuuucugcucaagaauaaagaacuuacggaggccaagguaaagaaacuguugaaccuaucugaaauggcgaagguucagcugcagggccgugauaaaaagaaucagaaaaucaagggguaugcccucauuacucuggagagccuuccauucugguccaaacugcccgagcaacagcaggacgaguucuuguacgauuggaacaagcucccugacgaaaagcugaaagaucgguuacgaaauuauuacaagcugaccgacgaugaaaucgacgagacauuucaaaacauagugcuaccaucaaauuaugcaccgcucgguaaaaaggcuauggaaauucugcuugaguacaucaaaaacggauugaguuacaucgaggcccuggauaaggcugccgacgaaaauaagauuaaagucgagaagcacgaaaucaacgaucuccugcccuauuacggcaaaauucuucaggagagcacucagaugccuauagggaaggcauucucuaaacaauuugccgcuaagaauuauaagaaaccagacaucaacaagaaugaacaggaguucggaagaauugcgaaccccguggugcaucagacccugaaugaguugaggaaacucaucaacgaaaucauuacagucuuuggcaagaaaccucuggagauauccuuagaaaccucacgcgagcugaaaaagagccagaaagagcgggaacuaaucgcaaagcaacaggacauugaugaggagaaaagaaagaaaaucuggaagacguacauugaaccacaccuccagcagaucaaaaguaggucugacaagcugaagaaacuuuucguuuuugaauugugggaggaucaaaagcauaacugccccuucugucuggagaaaauaaauguggacgauaucuauucccgcgguguagacaaggaacaccucuuuccgcugaaaaagagcgaggaugacucggaaaacaauuuagugauugcccacaacaagugcaaugcucgaaaagccgagcgggcaccuuucgaugccuuugggcaugaaucuaucuggaacgacauuuucuccaaugcugagaagaaccugccccguaaacuuuggagauuuaggcagggaucauucgagaaguucuuggaaaaaccaccuaugcucaagcgcuuugagacugauaauaguuacaucagcaagauauccgcccgguaucuggcaugucuauucgacaaacccucuaagaucuuuugcgucaaaccauuccugacagcgcagcucagaauugcuuggcagcuggaugaaauuaugaucaggcuugccgagaacauaaucuuggacagcgaaaaggacucauuuaauaaaggcggccugcaaaagaagaaacgaauugauaaccgccaccaugcauuagacgccgugguuaucgcuuacgccagucggggguaccacaauuuccucaacagagugcaugcaaagggauauaaaauuaauuacgaugagaagaccuggcuguccgagacucuuaggcccccugguaacaaaaaccuggaagacuuuaagagcggcaucauaaaugucaugauuaacgcuaauaucucuaucaagcacgaucacaacaauaaagggcaguuggugaagucaaaagccuauaagcucuacuauagugagauuggaaaauacaucauuacaacccuuaagagcguauccgaaauacuauucaaacagaaggagaagccacaggacacgcugcgucgcgcgcucuguaaauuugaggaucggcugucugacaucaaggauaaaaagcugaggaaaaaguuggaagacaacauuaccaucuauaagucgauugagaaugaaagcgcccuguccaaagcuaagcaagaguuagaagaguucgaucucaaagcaaagaaagagggcaagaaggguuacgagaaaaucacagacauacugaucuacaagaaagccugcucaaugcaugggggcaaguauauucacguuaaaaacagaaucgaaaauaaguuuuucgcucuuaaggaaccgacugagauugaaaccggauuuggcuacgauacagccgacaaccugagucuagaccucuaucaugauaauaacgggaaacuguguggagaggugauccgaaagauagacuucaaucggaaccgcguccccaauuacaaaaaggaggguuauauuuugcuggaaagaaucuaccagggcgauacuuuagagguggacaucucugaugacaaaauuagccucaagaacaaagucggguccgcaccugauaagaggaccuucgugaagguucugacauuuaccgaaucagaccgguaucuuaaaaacaagcgagaucagauacaaaucuucuuuugcaaucuguugaaaagcacucucaagcacgacgauucuuccaaacacgacgacaguuucuacgugagcucuaugcagaaguacaacguaagaaaggucauucugacgucccuaggaaucauuaaauaucgcucaaagauccugaaaaauaaggagauauga

SEQ ID NO: 2871 - RNA, 3531 nt, Artificial Sequence
  Cas9 variant
augcuguuccccaagaaacucagcaaggaggaaguggccuacguccuuguugagaucaacuccaaucugaacaauucuucaaacuauuugggcaauauuagugacagaagcaaagaauuauacuuuaacaagcagaccauagggcaauuccuguauacaaaacuaaaggaggauaggcacuacucccucaagaauaaaguguuuuaucggcaggacuaccuggaugaauuugagcgcaucugggagacucaggcuauuuuucauaaggaacuuacggaggaccugaaaaagcagauccgagauaccauuaucuucuaucaacguagauugaaaucucagaagggacucauaucgcugugcgaauuugagaacaaggagaucacaauugaaaaagaggguaagacuguaaccaaacagaucggcgugagggucauuccuaagucaagcccacuguuccaggaauuuaaaaucuggcaaauacucaauaacgugauuuguaagaaaaaggggacacggaagaaaaaggcaguuaccccggcccccuuacuguucgagcuuuuuggaacuccuagugaaacauucuuuuccuuggacauggagugcaaacagcugcuauucgaggaacucaaucugaagggcaaccuuaaagcggauaaggugauccgccuguuggguuacauuccacaggagugggaaaucaauuacaaccagcucgaggggaauagaacccaaaagucucuguaugaagcauacuuaaaaaucauugagauagagggauaugacaucaagacguuccugaggauuaaaagcgauaaggaagacugggaucucgaggaaucaccccuuuccgccaaagagauccgggaaaacauacagcacauuuuugagacucugggcaucaguaccgcaaucuuguacuucgacgccacacuaccuauuaaggauuuugagaagcaggcuagcuaucaacuguggcaucuccuguacucuuaugaauccgacaacucaccaagcggcaaugagacucuuuacaaacuguugcaggacaaguucggguuuaaacgcgaacacgcagucuuccucaguaacaucucuuuucaggaugacuacggaucccugagcgccaaggcuauucgaaaaauauaucccuacaucaaggagaaucaguauucgaccgccugugaguuagcggguuacagacauucuaagcugucccuaacaaaagaagaacucaacaauaggccucugaaggaucuuauuucaccauugaaaaagaacagucugcggaauccggugguagaaaaaggccucaaccaaaugaucaauguugugaacgcacugaucgagaagaauagcgaaaaagacgccgaggggaacauuauaaaguauuuccacuuugaugagauccguauugaacuugcucgcgagcugaagaaaaaugcccaggaaagagcagagaugaccuugaacaucaagaaugcuacgauugaacaggagaaaaucaaguccauacucaucucugacuucggaauuaaaaaccccacuaagaacgauaucacaagguaccggcuguaucaggaguuagcccacaaugacuacaaggaucuguacaccaacacugacauuccuaaagaacuacucuuuagcaagaauaucgauauagagcauauugucccaaaagcgcgaguguucgacgacucauuuaguaacaagacacuggccuaucgcgauuucaaucuuaaaaagggcgaaaacaccgcauucgacuuuaucgauuccagcuugggugaggaggagcugaaucaauacauugcuagaguggagaacgccuucaagacgaaaaauaucucugcuaccaaguauaggaaccuccugaaaaaggccacagaaauaaaugacggguuuaucaaccgggauuuacgcgagacucaguacauugcuaaaaaggccaaggaccugcuuuuccagaucaccagaucagucguuaguacaagcggauccauuacugauagguugcgugaagacuggggccucaucgauauaaugaaagagcugaauaugcccaaguaucgggaccuaggccugaccgagauuaucgaacgaagagaugggaggaaaguggagguaaucaaggacuggacaaaacgcaacgaucaccggcaucacgcuauggacgcgcucaccguggcauuuacuaagccuucuuacauucaguaucugaaucaccuuaacgccagaaaagacgaaaacaauaaguuguacgcugauauccugggaauugagaggaaggaaacgacaaaaauacaugacgagaacgguaaugagaagcgcgucuucaucgaaccaauucccggcuuucgacaaaucgccaaaaaguacuuagaggaaauucucaucucgcacaaaaccaagaacaaggugguuacuaaaagcauaaauaagaucgcagggaccaacaaaaagcaggagacacugaccccgcggggacagcuucauaaagaaacuauuuauggcaaguaccacuauuacuccaauaaggaggagaaaaucgguacaaaguucgauaaagaaacgauuucaaaggugaguaacccuaucuaucguuacgcccugcagaaaagauuggaggcuaaugaaaacaaucccaagaaggccuuuaccgggaaaaacgcacucucuaagaauccaauauaucuggacgaugcgaaaacuaagauucuaccugagaaagucaaccugaucuaccucgaagaggacuucagcaucaggaagaagauuguguccgagaaucccacaucaaaagaauuuguaccaaacagcauaucuaucgagaagauuguugaugaaggcaucaaacgcauucugaaggagcggcuugagaccuacaacaaugaccccaaaaaggcuuucgccgauuuggacaaaaacccuaucuggcugaauaaggaaaagggaauauccaucaaaagagugacaauuaguggcgucaagaacacucaagcauuacauagcaaaaaggaucaccucgggaaaccaauccuggacaaggagggacaggaaauuccgguggauuuugucucuaccgguaauaaccaccauguggccaucuauagggaccagaagggcaaucuucaagagcagauaguuuccuucuucgaagcugugguacgagcccagcaggggcugcccauuaucgacaaaacguacaagcaagaggagggauggcaguuucuauucaccaugaaacagaacgaaauguuugucuucccuaaugagaucacaggcuuuaacccaucagaaauugaucuccuggaccccaagaauaaaaaguugaucaguccuaaccuguuccgcgugcagaagauaagcauuaaagauuauuucuuccggcaccauuuagagacuaauguugaaaccaacaauauccucaaggacauuacauggaaaagaggugggcugucgcuucugaagggcaucauaaaagugaggauuaaccacuugggaaauaucgucuccaucggcgaguacuga

SEQ ID NO: 2872 - RNA, 3534 nt, Artificial Sequence
  Cas9 variant
augaacaaggugcaggagaucgaauacaaaaagauuaaagagaagcuggccgacagagaauauaggauaggccucgaucuuggggucggaagcaucgguuacgcuguugugucccugaaaaaguaugacgauuugucuuacuuacccgaggacauuauccuggcaggcucacggauuuucgccaguagcaucggggcgguagaacgccgagaguuucgucuacaaagaaauucccacaggcaucggcgcgagagaaugagguuccucuggaagcugcuugcugaaaaacagcuggccuugcagccuucuaaggaucucgagaaaaaggaaaacucggcagacugcgagaccucacagaaacgguuuccaauaaauauccugaagaacgauccguauauucugcgcuacaaggcccucgacgagaaauuaagccuguuccaacuuggauauguguuguaccacgucgcuaaucaucgaggcacagauaguaucagauccuuucuggaagacacugaugacaagauuaaagagaacacgaagaccgcaaaacuagccacagaaacuaagaaaaucauagauucuaagaaguacaggaccuucggugaguaucucuacaaagaacggauucagcagaaugagcguaagaaagugagcaaccgcaagacagcugggaauaaaaacaaggaguuugccguuaccagagacaugaucuucaaggaaacugagaaaauucuggcgucccagaagcaauauuacacaaaugugcuuaccgacgaauauaucaaagagaucgaaggagcaauuuucuaccagacggagaagcugauacccgagucaggcuauuguccuuacuucaaagaugaaaagagguugccaugcagucacaagcucaacgaguaccggcgaaucuaugaagcccugaauaacgcucgcuacagcgcccccgucuuagacgagaaaacuggcgaaauucugucuuaucaggagggggaggaauuuuccucagaggaaaagaaaauccucuucgaugaggugcuucugaagggaaagaaguugaccgagagcgaaauaaagaaacuacugcaucucccugacgguugugagauucagcugcaaggcagagauaagaggacacagaaaaucaagggguacgcacuuacugcucuggaagccuugccauuuuggaguaaacucucucagcaacagcaggacgaguuccuguaugauuggaauggauuacccgaagagaagcugaaaccuaagcuaaucgacugcuacucccucaccgagaacgaaguagaugagacauuccagaagauucggcugccaagcaacuaugcgccgguuggcaaaaaggccauggaaauccuuuugaccuacauuaaagacgguuacucguauacggaggcacuggauaaggcugugucugaagggaaauuuaaggucgacaagcaaacuacaauauacgacucccuccccuauuacggaaaaauccugcaggagucaacccagaaacuuauuggcaaagccuucaguaagcaguuugcuaaacgcaauuauaagaagccuaacacuaauagaaacgagagggaauuuggcaaaaucgccaauccaguggugcaccaaagccugaacgaguugcguaagcucaucaaugaaauuauaacagucuuugggaaaaagccccuggagaucggauuagaaaccgcacgggagcugaaaaaguccucuaaggaucgagagagccuaguuaaacagcagaacgaaaaugaguacaacagaaauaagauuuauaaagacuacguggaaccucaccucucacagaucaagaguaggcaagagaacccaucccgcuacauuuucaaauuugagcuguucgaggaacaaaagagcaucugucccuuuugccuuaaagaaauaacgccggaugacaucauuaauucuaagguagauaucgagcauauuuucccuaucgaagagucagaggacgaugccaagaacaauuuggugauagcucacaacgaauguaacgcggacaaagguaagaaaagucccuuugaugcauucggcgacaagaccagcgggaaauaugucuggaaugauauucugcauaacgccaagaagaaucucccacacaaaaucuggcgguuuuaccagggaucccuggagaaguucuuagaaaacaaaccuaugcugaagagauucggcacagacaauucuuauauuucgaaaaucgcugccaaguaccuugcaugcuuguuuaacaauagcuccaagauauucuguaucaaaucaagucucacugcccagcugaggauugcuugggagcuaaacucuaucaugauuccccuggccaagaauauccucagcgaaaaagagcuggaggaauuuaagacccuuaaaaacaagaagauacgcauggauaaucgacaccaugcauuggacgcgauuacaaucgcuuaugccaaccgggguuaccacaauuuccugaacaaaauccaugcaaagggguauaaaauugacuaccgugagaagaauugguuauccaaaauccuccugccaccccuuaacagagaucuggaagacuuuaagauuucagugaagaacagcauagagaaagccaauguuucuaucaagcacgaucauaaaacuaacggcuccuuggugaagggaaccgcuuacaaagucuauuacaguggcacagggaaguauauuaucaccacucucaaaaauguggaagagauuagcuucaaggagaaggaagacccugaggauacgcugaggcgcgcccuaugcggauuugaagacucuaacaucaaagaugagaagcugauuaaaaagcucaaauacaauuccgaccuguauaagaagauccuuaacacaaaaccaaaggcaaaacaggaguuggaacaggcuaaucaggagaccaaggaagaggguaaaaagacucaaaagauuaccgauguacugaucuacaaaaaggccuguucauuaguuggcgaacaguauauucagugcgcgagucggcucgagaacaaauucuuugccgugaaggagccgacagaaaucagaaccgggauaggauacgacacuggcgauaaucuguuccuugaccuguacuaugauaaaacaaggaagcuaugcggugagauuauccgaaagaucgacuuuaaccagaauaaaauucccaacuaccaaaaggaaggguauauacucuucgagcgcaucuaccagggcgacacgcuggaagcugauaccagcgaggacaaaauuucguugaagaauaaaacuggauccgcacuggauaaccggacauuugucaagguguuaaccuucacagagucugacaaauauuucgauggcaagaaggacaaaauccagauauuuuucgggaaucuccuuaagagcaacuacaaacaggaugacucauuuuauaucaguuccaugcaaaaguacaacgucagaaaagugauacugacuucucugggaaucauuaaguacaggagccagaucuugaagaauaaagaaguuuga

SEQ ID NO: 2873 - RNA, 3540 nt, Artificial Sequence
  Cas9 variant
augagcaagaaaguguccagaagguacgaggaacaggcccaagagaucugccagcggcugggcucucgccccuauucaauugggcucgaccuuggagucgguaguauaggcguugcuguggcagccuacgauccuaucaagaaacagccaagcgaccugguauucguguccucucgaauuuuuaucccgucgaccggggcggcugaacguagacagaagaggggacaacggaacucauugcgccacagagccaauagguuaaaauuccuguggaagcuacucgcagagcggaaccugaugcuuagcuauagugaacaggauguccccgacccugcccgccugcgauuugaggaugcugugguuagagcaaauccauacgaguugaggcucaagggccugaacgaacagcugacacucuccgaguuagguuaugcccuguaccauauugcuaaucaccgggggucuagcuccgugcguacuuuccuugacgaagagaaaucaagugaugacaagaaauuggaggaacagcaagccaugacggagcagcuggcgaaggaaaaaggaaucagcaccuuuauagagguccuaacagcauucaacacuaauggccucaucggcuaucgcaacucugaauccgugaagucaaaggggguacccguuccuaccagagauauuaucagcaaugagauugacgugcugcuucagacacagaaacaauuuuaccaggagauccugagugaugaauacugugacaggauagucucugccauuuuguucgagaacgaaaagaucgugccagaggcuggaugcugucccuauuuuccugaugagaaaaagcucccacggugccauuuccugaaugaggagcgacgcuuaugggaagccauuaacaaugcaagaaucaaaaugccgaugcaggagggugcugccaagagguaccaauccgcgagcuuuucggacgaacagcggcacauccuguuccauauugcccgcucuggcaccgacauaacucccaaacucgugcagaaggaguuuccugcacuuaagacauccaucauuguccugcaggggaaagaaaaggcuauccagaaaauagccggauucagauucaggcguuuggaggagaagucauuuuggaaacggcuaagugaagaacaaaaggaugacuucuuuagcgcuuggaccaacacgccagaugacaagcgacuguccaaauaucucaugaagcacuugcuucugacugaaaaugagguuguggaugccuugaaaaccguaucucucauuggcgacuacggucccaucgggaagacagcaacucagcuguuaaugaaacaccuggaggauggacuaaccuauacagaagcccucgagagaggcauggaaaccggcgaguuccaggaacugagcgugugggagcaacagucacuuuugccuuacuaugggcagauccugacgggaaguacucaggcucucauggguaaguacuggcauuccgcguuuaaggagaaaagggacagcgaaggcuucuuuaagccaaacacaaacucugaugaggaaaaauacgggcgcauugcaaaucccgucgugcaccaaacccugaacgagcuucggaagcugaugaaugaauugaucacuauucucggagccaaaccgcaggagauaacaguugagcuggcuagagaauuaaaggugggcgccgagaagagggaagacaucauuaaacagcagaccaagcaagagaaagaagcaguccuggccuauucaaaguacugugagccuaacaaucuagauaaacgcuauaucgagcgauuccggcuccuggaagaccaggcuuuugugugccccuacugucuugagcauaucaguguagccgacauugcagcgggucgugcugauguugaccacauauucccaagagaugacacggccgauaacagcuaugggaauaagguggucgcacacaggcagugcaacgacaucaaaggcaagcgcaccccuuacgccgcuuuuuccaauacaucugccuggggacccauuaugcauuauuuggaugaaacuccaggcauguggcggaagagaaggaaauucgagaccaacgaggaagaguacgcaaaguaccugcaaucgaaaggguuugugagccgauucgaauccgacaauucauauaucgcuaaggccgcgaaagaguaccuccgcugucuguucaaccccaauaacgucacagccgugggaaguuuaaaggguauggaaacuucuauucugcggaaggcuuggaaucuucagggcaucgaugacuugcucgggagcagacacugguccaaagaugcagacaccucaccuacaaugaggaagaaccgugaugacaaccgccaucacggacuggacgccauaguugcucuauauugcagccggucucuggugcagaugaucaauaccauguccgagcagggcaaaagagccguagagauugaagcaaugaucccaauuccggguuacgcgagugagcccaaccucagcuuugaagcccaaagggagcuguuccgaaagaaaauccuugaauuuauggauuugcaugcuuucgucucuaugaagacugacaaugaugccaacggggcacuguuaaaggacacgguguauuccauacucggcgcugauacacagggagaggaccugguuuuuguggucaaaaagaaaauuaaggauaucggcgugaaaauuggggacuacgaggaaguagccucagcaauccggggacgcauaaccgauaagcagccuaagugguauccaauggagaugaaagacaagaucgaacagcuucaaaguaaaaaugaggccgcucugcagaaguacaaagaaagccuggugcaggcggccgcaguucucgaggagucgaacagaaagcugauugaauccgguaaaaagcccauccagcuaucugagaagacuauuagcaaaaaggcucuggaacucgucggcggguacuauuaccugaucucaaauaacaaaaggaccaagacauucguggugaaagagccuaguaaugaggucaagggauuugccuucgauaccggcuccaaccuuuguuuggacuuuuaucacgaugcccaagguaagcugugcggggaaauaauucggaaaauccaggcuaugaauccaucuuacaagcccgcauauaugaaacagggcuacagcuuauauguucgacucuaccaaggagacgugugcgagcugagagccuccgaccuuacugaagcggagucaaaccuggcuaagacaacgcacgugcgccuaccgaaugccaaaccuggcaggaccuucguaaucauuaucacuuuuacagaaauggggagcggauaccagauuuauuucaguaaccucgcaaagucuaagaaaggccaggauaccuccuuuacacugacuaccauaaagaauuacgacguccguaaagugcaguugagcucggccggucugguucgguaugugucaccauuacucgucgauaagaucgagaaagacgagguggcucuguguggggaauga

SEQ ID NO: 2874 - RNA, 3567 nt, Artificial Sequence
  Cas9 variant
augaaguacauccugggccucgacauuggggugagcuccgucggaauagccguuaucucugaggaaaaccagaaaaagaccauugagaaucuugcugugagaaucguacccgaagauccugacuuccacgguaaauuuuauucaggcaacacagcaaguaagaaucuggagaggacugccaaacgggggaaccgcaagaauaaccaacgauucaaggcgcguagagauaaauuguaccagagcuuaaaggaaaauaacauguuuccaacguccaaucuguucgaccuaucugcuguggagcucuauggacugagggccaaagcagucucggaacaggugucacuucaggaacugggccggauuuugauccuccugaaccaacgcagagguuuucugagcaauaggaagaguguuuccgaggaaaacucuaccgaguacaaagagcggauagccgggcucgaaaaggcuuuaggaaauaagacaaucggccagaaacuguauagcgagcuucaggaaaacaauaacguguucgaggucuugcugcgcgaacgaacuuaccagagauccucauauaccgaggaguuugauaggauuugggacgaacaaaagaaauacuaccuaauccucacaggcaguagcaacgaggaugacaauaaggggacccuguaugaucuuauucggaaccguaucauauacuaucagcgcccgcugaaaucucagaagggauugauuuccgaaugccucuucgagaaacaucacaaggcaguggccaagucaagccccuacuuugaacuguucagaaucuggcagaaaauuaaugacuuaaguuggaagacuccuaacggugagcuguuuaaaccaacagaugagcaaaagcagaaacucaagaaugcucuuuggaacggcgacaaucugaaccccaagcauaaauugaccguaucuaagaucaaagaaauccuaggguauacguccagggagaagauuuaccugaauuucacugaacucgauggaagccggaccuauucgauacugcgaaacgcccuuaucgaggcgggcauugaaaaaccugagcaguaccuguuuuucaauauggagacaaacgacgaaaaggguggguuguucgagcucuggcacaucacuuacucucugccaauagaaaaggagguuauuaaugcauuaaagaaccgcuuuggauucgacaagaaacaagccgagaucaucgcuagaagggugggcuauuccucagauuacggcagucugagcacccgggccauucgcaagcuacucguccaucuggaaaaagggcuuggauauacagacgcaugugauaauaucgguuacgaccacuccggcuauaagaccaagauugauuugcagcccaaacugaagcagcucaaaagaaacgagcugaggaacccugugguggaacagauacuuaaucaagucguuaacgcugugaaucugaucauugagaaguacgggaaaaucgacgaaauccguguagaguuggcccgggagcuccgaaacaaugcgaagacgaggaaaaacauuucucuguuaaauagcaagaacaagaaaaauaacgauauaaucagaaagaaacugcaggaagaguauggauuuaaguucgugaauggccgcgacgucacucgguacauucuaugggaagagaacucaaaagaaugccucuacuguaauaagacaaucaacgguagugauaugcugaccgggaaugccgacauugagcacauccuuccaaaguccaggagcuuuaacaacgcaaugaauaacuauauaaucacucauagaaaaugcaauucugauaagggccagaaaacagcuuacgacuucaugucaaguaagggagaggugauuuugcagcaauauaucgaaaaaguuaacgaccuguacaaggauggcaaggggagcauuuccaaaaccaaguuugagaaucuccuguguaaaggagaagacaucccgucugauuucguggagcgcaugaagaaagacucgcaguauauagccaaggaagcugucaagauguuaaaaacggugugccccaacguauacaccacaacuggucagguuaccgauuuucugcgagaggaguggaaacuuaaaaauuugcuccaggaacugacauucgagaaguauaaagccauuggccaagugaaggagaaaaucauuaagacuaacaaugggcagaccaagacauuuaaagucaucgcagacuggagcaagcgggaugaccaccgucaucacgccauagaugcucuaaucugugcgcugaccgaccagaaaauuaucuucaagcucaacaaucugaacaaaauuuaccaguacgagagaaaugcacuuucccaaaaggagaucgaagagauagaagaguuuuuggaaggaaaguucucaauuaaagaguucagugcccagcagggcaacaucaucgagugcucuauuccuaauaucaggaaggaugcucaaaaacaccuggaaaacauuuuaauuagcuuuaagaaagagaacuccaaggugcucacuaugaaucgcaaccagccaaagaauuguaaagaacagaucacgugggucccccgggccagacugcaugaggacacaauuauggguagggugaagcgaaucccugagaaaaagaugaaacuuaacgauaagguuucauucgaacagauuaagaugaucgugaauccagagauaaaagaaauccuguuguaucgccucgcaaaguuuggggacaaccccaaaguagccuucgcuaccaaggcccugaaaaaggagccgauauuuuaccgggaaaaugagcuaaaggaagucagcaucuaugagugggugaacacuaaaagaguugcacugaaugagaacauuaccgacucucaaaucgaaaagauaauugaucaggcguccaaaagggcugugaaggagcgucucaauggcggaaaaaucaaggaagucuucaaaaaccugacagagaauccuauccagcuuaagaacggcaugauuuugaagaaugugaccguaacugacgagaguaaaguggaaaagauacgcaacggguuugccaucacagguaaaaaucaccaugcacugguuuacaaggaugagaacggaaaauauaacgacaaggucgugagcuucugggaagccguggcuauuggcuuacggaaugucacggaguacgggaaccccuauccaaucauuaauagaaaccacaaugaugaacucggagaguuuuacuucucuaugcagaucaacgaccuguuuguuuucgaucuuaagcauuccgagaauccucaagaagagaacgaaauaaacuuuuucgacguggagaauaggaaacagaucucagauaagcuguuccgagugcagaaaaugaguaagaaaagcaauggccaguuuguaucggacuuccggcaccaccuagaaaccuccgucauucgcaacgauaugauccucaagaauauuacuuggaucucuauaagcaagaacucagaccuggagagauugacaaaaauuagggugaaucaucugggugagaucaucaagguuggggaauga

SEQ ID NO: 2875 - RNA, 3585 nt, Artificial Sequence
  Cas9 variant
auggacuucaccgccgaugugagcgagcugaacgaauccuuuaugcagauccacacagagucuaaguucgaaauugacacugcuaaaguccaagagauaucacagcuccuucuggauaauaagaucacgagaauggacaggcagaaacagguugcaaacguguuggccaagaauaguggcgauaaagaagcggacaagauuaacaagaaaaucgcuaccgaguuuugcaaggccguauuagggaauaaagcaaaguucaacgugauucugggagaggaugccgucgacagcgauugguccuuuaaaauggacgaugaaaauucugacgaggaaaucgagauacuaaugggucaaacaaacggccagcagcagaaugugcuccggaucauucaucaaugguacucgcagaucacucugaacgggauuguucccgauggacagaugaucucagagagcaugauagacaaguaugaacuucaccgcaagcaucuguugcuccugaaacagcaaauuaaggugaccaaagacaagaaaaaggcucagcagcugcacgaggcauacgaacaauauguccauggcacaggugccaaaaagaagcucacccaggaugacuucuacaguaaagugacuaagaauuuagagacauccgauuuuucugacgaaaucaaaaagcagauuaacgcugagaccuucaugccuaaacagcgaacgagcgccaaugggguaaucccacaccaacugcaccagcaggagcuugauaagaucauugaaaagcaggcgaaauauuacccguuuuuggcagagcugaaccccgacacuaagcgucaaaauauagccaaauauaagcuagaugaacucaucgcuuucaaaauuccuuacuacguuggaccacugaucaccacagaggaccagaagaagacuuccggcaaaucauuugccuggauggugagaaaggaacccggcaaaauaaccccuuggaacuucgaucagaaggucgacaaaauggcaagugcugaucaguuuauuaggcggaugacaaccaaggacagcuaucuuaucacggaggacgugcugccagccgagucuuugaucuaccaaaaguauaaagugcucaacgaacugaauaugauucgcgucaacgggaauaaguuaacuaaacaugauaagcagaacaucuaccagcagguuuucgagaaauauaagacagugaauguaaagaaggugcaaaacuacuuccugaccgacggaagauaucagcacgcgcccaagauuacuggucucuccgaugacaauaaauuuaacucaaaucuuagcacauacauagauuucaagaaaaucuuucaggacgucguggaugacccucaaaagcagaaagauuucgaaaggauuaucgaguggaguaccaucuuugaagaccggcauauuuacgagguuaagcugaaggagauaucuugguugaacgaugaacagcgcaaagagcuaaagaaaaagcgacaccagggcugggggagacuguccgccaaacuccugacgggaaucuucgacgaaaauggcuauagcauuauggaucaacuuuggaacacccagaagaauuuuaugcagauccaggcagaggaggguuucaacaagaaaauucaagcugaaaauucgaagcaccuggagaaaaacgacuuugaagacaucuuggaggaugccuacacaucuccacagaacaagaaagcuauaaggcaagugaucaaggucguggaagacauucagaagacuauggggaccgccccgcagaaaaucuccauugaguucacacggucagcagauaagaauccccgucgcaguaucgagagacagaggcagcucgaagagauauauuacaacgacgccaaagaaauuguaagcgagggaaugcaagauaaucugcagaacuuuacugacaauaagcagaccuuaacagauaaauauuuccuguacuuuacccagcuaggcaucgacauguauacuggcaagaaaauuaacaucgaugaaauagggaauuaccaaaucgaccauauucucccucaggcuuucaucaaggaugacuccauugauaacaagguucuggugucuagcgcgaucaauaacggaaaaucagacaaugucccacuuaguauguacgcauccgugcggauaaagagcgagguccagaacaaauggaagaauuucgccgagcacgguuugauuucucagcgaaaacugaacaaucucaugacggaccccgaaucaaucgauaaguauaaggcucgcggcuuuaucaaaagacaacugguggagacaagucagguuauuaggcuuguggccgaaauccugaacgagaaguaccagggggaaaccgagauuauagagguacgggcaaaaaugaacagccaguugcgcaaggacuucgaucuccugaaaaauagaaacgucaaugacuaucaucacgccuuagaugcuuaccugacuaccuuuaucggaaacuaucuauacaggcguuauccuaagcuccgguccuacuucacauacggccauuuuaagaaaauugacgaugccaagcugaaacaauucaauuuucuucacgacaucgaaaacgauaaggacccaaaauaugugaaugauaacggugaguugcugugggaccgagaaaaggacauugcauacuucaagaaaaucuauaauuuuaaguacaugcucguuucucacgaggugucgaccagacagggggcgauguucaaacagacuauauuucccgcugccgcagaugccaagagcaaacugaucccgauuaagaacgacaagccuacagcuaucuauggcggauacacgaauaacaaugaugccuauuuagcaauuaucaaacuggcuaagaccggccaguucaaagucguggggguaccccaaagggccauagugaaacuuaaacaggcguacgacaaggagacuggagauuacuccaacguuuuguauaaaguccucgaaccaaaguuugugaagaaaaaggugaaucgcaaaacaggugagauuaccuaccaggucgaaaaguucaaaaucguugugccuaaggugcccuaucggcaacugguaaucgacggcgaucagaaguucaugcuagggucaaguacauacaaauauaacgccaagcagcugguccucucugagaacgcuauuaaaauacuggacaagaaauccuuugaucagagcggauacaagucaagcgaccuugauacuguguaugacgaaaucuugucucaaguugauagauacuucuccauguacgacaagaauaaauuuagggagggccugcauaacgguaagaaauauuuccagcgcuuaccaaugauugacaauguggagaaggggaaaaucaaggaaaacggcaaguuuaaacuccugaaugagauucuuaucggacugcacgcaaaccccaguuucggcaaucucaagagcuuggggauaucuaccccuuuuggaaugaugcaguucgccuccgguaucucacugagugaaaacgcuauucuauguuaccagagcccaacgggcaucuuugagcgacgggucgcccugaaagaucucuga

SEQ ID NO: 2876 - RNA, 3588 nt, Artificial Sequence
  Cas9 variant
augcagaagaacaucaauaccaaacaaaaccacauuuacauaaagcaggcccagaaaaucaaggagaaacugggcgacaagcccuauagaauugggcucgaucuuggaguggguagcaucggcuucgcuauugucuccauggaagagaaugacgggaacguucuguugccuaaggaaaucauaauggugggaucuaggaucuuuaaagcaucagccggcgcggcugaucggaaguuaagucgcggucagcgaaauaaccaucgucacacaagagagaggaugcgguaccuguggaaaguacuagccgaacaaaagcucgcacugccagugccggccgaccuugaucgcaaagagaauagcuccgagggggaaacuucugcuaagagauuccugggagacgucuugcagaaggauauuuaugagcucagggugaaaucgcuggacgaacggcugucacuccaggaguuaggcuacguucuguaucauaucgcaggccaccgcgggagcagugccauucgaacguuugagaacgauuccgaagaggcucagaaggaaaauaccgagaacaaaaagaucgccggaaauauaaaaagacuuauggcgaagaaaaacuacaggacauauggugaauacuuguacaaggaguucuuugagaauaaggaaaaacauaagcgggagaaaauuucuaacgcagccaauaaccacaaguucagccccacucgugaccuggugaucaaagaagcugaggccauucuaaagaagcaagcaggcaaagauggguuucacaaggaacucaccgaggaguauaucgaaaaacugacaaaggcuaucggauacgaguccgaaaaacuuauuccugagucaggcuucugcccauaucugaaggacgaaaagcgcuugcccgccagucauaaacucaacgaggagagaaggcugugggaaaccuuaaauaacgcgcgguacagcgauccuauagucgacaucgugacuggugagauuacaggguauuacgaaaagcaguuuaccaaagagcagaagcagaaacuguucgacuaucuccuuacgggaucugagcugacuccagcccaaaccaagaaguugcuaggccugaaaaauacaaacuuugaagauaucauacuccagggccgagacaagaaagcacagaagauuaaaggguacaagcugaucaaacuugaguccaugcccuucugggcucgccugucagaagcccaacaggauagcuuuuuguacgacuggaauaguuguccugaugagaagcuccugacugaaaaguuaucuaacgaguaucaccugaccgaggaagagaucgacaaugcuuucaacgaaauuguacuauccagcucguacgccccacucggaaaaucugcaaugcugaucauucuugagaagauaaagaaugauuuguccuauacagaagccguugaggaggcucugaaggaagguaaacucaccaaggagaagcaggcgaucaaagacagacugccguacuauggcgcagugcuucaggaaucaacgcaaaagauuaucgccaaaggguucaguccccaguuuaaggauaaaggauacaagacuccucauacaaacaaguaugagcuggaauacggcaggaucgcuaauccagucgugcaccagaccuugaacgagcuccggaaacuggugaaugagauuauagacaucuuagguaagaaacccugcgaaauugggcuggagacugcccgcgaacuaaagaaaagcgcagaggauagauccaagcucucuagggagcagaacgacaaugaaagcaaccguaaccggaucuacgagauuuauauccgaccucaacagcaggucauaaucacaagaagggaaaauccacgcaacuacauucugaaguucgagcuuuuggaagaacagaaaucacaaugucccuuuugcggcggacagaucaguccgaaugacauuaucaacaaucaggccgauauagagcaccuguucccuauugcugaauccgaggacaacggccggaauaaccucguuaucagccauucugccuguaaugcagauaaggcgaaaagaucacccugggcugccuuugcaagugccgcuaaggacagcaaauaugauuacaacaggauucuguccaaugugaaggaaaacaucccacacaaagccuggcgcuucaaucagggggcauuugagaaguucauagaaaacaagccuauggcugcccgauuuaaaaccgacaauucuuauaucucgaagguagcgcauaaauacuuagccugccuguucgagaagcccaacauuaucugugugaaaggaagccuuacggcucaauugcggauggcauggggucuccagggccugaugauuccauuugccaagcagcuaaucaccgagaaggaauccgagucauucaacaaagaugucaauaguaacaagaaaauacgucuggacaauagacaccaugcucucgaugccauugugaucgcauaugcgucuaggggguacggaaaccugcuuaauaagauggccggcaaagacuacaagaucaacuauagcgaacgcaauugguuguccaagauucuguuacccccuaacaauaucguuugggagaacauugaugcugaccucgaaucauuugagagcucugugaaaacagcccugaagaaugcauucauauccgucaaacacgaucacagugacaacggugagcuugugaaggggacuauguacaaaaucuucuauagcgaacggggcuacacccugacaacuuauaagaaguugucugcucucaaacugaccgacccacaaaagaaaaagacaccgaaagauuuucuagagaccgcccugcucaaguucaagggaagagaauccgagaugaaaaaugagaagauuaaaucagcaaucgaaaacaauaagaggcuguuugacguaauucaggauaaccuugagaaagccaagaaauugcuggaagaggaaaacgagaagaguaaggcugagggcaaaaaggagaaaaauaucaacgacgcgagcauauaccagaaggccaucucguuauccggggauaaauauguucagcucucuaagaaggagcccggaaaauucuuugcaauuagcaagccuacuccaacgacaaccgguuacggcuacgacacuggggauucacugugcguggaccuuuauuacgauaauaaaggaaagcuguguggcgaaaucauucgaaaaaucgacgcucaacagaagaacccccuaaaguauaaagagcaggguuucacccucuuugaacgcauauacgggggcgauauucuggaggucgacuucgauauccauagugacaaaaauuccuuucggaacaauacaggaucugccccugagaacagaguguucaucaaagucggcaccuuuacugaaauuacaaauaacaauauacagaucugguucgggaacauuaucaagagcacgggaggccaagacgauuccuuuaccauuaauucaaugcagcaguauaacccaaggaaauugauccugagcaguugcgguuucauaaaguaccguucucccaucuuaaagaauaaagagggguga

SEQ ID NO: 2877 - RNA, 3594 nt, Artificial Sequence
  Cas9 variant
augagcaagcacgugcugggccucgaccuuggggucggauccaucgguuggugccugauugccuuggaugagcaggaccaacccgcugaaauauuaggcauggggucuagaaucguuccucugaccacagaugaccuaaacgaguucucacagggaaaagcaauuaguaagaaucagaaaaggacuacgcagcggaccauccgcaagggccucgaucgauaccaacugcguagaaaagugcuuagcgaaaagcuggccggucaugggauguugccagacaaggaucucaugcagcugccgguacuggaccucugggaguuaagggcgcgggcugccucccccggagaaaaacugucucuuccugagauuggccgcguguuguaucacaucaaccagaagagaggcuacaaacaugcaaagucggaugaggccgaagaggucacaaaaagggggaaggaacagggauauguggcuacuguuaagggucgguacgcagagcugcaacgcgagggcgccaccguggggcagcacuuugcuuguaaacuaaaggaacaucgacaggagucaccaagcggaggcuucuuuuauaauuacagaauaaaagaccaggucuaucccagggaagccuacaucgaggaguucgaucggauuauggaagugcaaaguguauuuuacccugagguucucacaccagcguucauccaggaacugcgugacaaggugaucuuuuuccagcgcccccuuaaauccugcaagggucuggucucuuuuugugaguucgaaaaacaagagagaguggugcaguugaagagggucaaccgggaagggaaggaggagcuccaggaacgaaaaauuaccauaggaccuaagguugcaccaaaaagcuccccgauugcccagcugugcaaguuaugggagucaauccacaauauucgcaucuauuaccccgauggcaaagaaagaccuaucacucuggaggaaaagaggaagcuccuugcuuaucugcaaacacacgacaaauugaccuuuacggcccuaaagaaagagcugaagauuagugacaaagagcggcucuggugugauaagcugcuuaagggcgggauaaaaggagacacuacccgcgugcuguugagaaaggcacucgcugguuacaaaagguaugaaccacuguuacguauggaucuggagcuacgggacuuccaggaaaucguaagcggcaagcgacucauuagacccaucguggaugagucuuaccugucccagccucuuuauagguuguggcauauacuguacucaauugaggaacgcgaggccaugcggagagcgcucaucgaccagcugggguuucuugaagaggaucuggacggaggcuugcucgauaaacuguaccaaaucgacuucgccaagcaggguuauagcaacaagagugcaaaauucauuugcaaguuacugccacaccuacaagggggccauggauacucucaggcuugugaacucgccggcaaaaggcacuccgcugggagccugacaaaggaggagcuugaggaacgccccuugcuggaacacaucccgcuccugcagugcaaugaguuacgacagccuauugucgaaaagauacugaaccagaugaucaaucuugugaacgccuugcggcagaaguauggaucgauugaugagguucguguggagcucgcaagagaacugaaaaugucuagggaggaacgcgaggaaacuuccaagcggaucagaucaagggagaaggagaauaaagaaaucgccgagcgaauuaaggaauacgagcuauaucccaccaaaagucgcauacaaaaguaccggcuguggcaggaggcuggugaacagugucucuauugcggcagaagcaucgacgucgugcaauuucugcguggggacggaguagagauugaacauaucauuccaaaauccauccuuuacgaugacucuagcgcgaacaagacaugugcaugcucaaggugcaauaaggauaaaggcaaccgcaccgccuacgaguauauauuggcugaaggucgggaggccgaguaccuggacagauuagaaacucucuuccacgaugggaagcugaguuauuccaaaaggcgacggcuucaguggaagaaagcagacaucccuguugauuuuauugagcgccagcugagauugacgcaguacaucgccaggcaagcucaggaaauucuccggcagggcauccgaagagugggagccagcgagggcucugucacagcaaagcugcgccaucuauggggguaugacgauauacugagggaacucaauuucgagcguuaccagucaaugggagagaccgaaauugugagucaagaggaaaaggacgguagcaucacuaaauccgagcggauuaaggauuggucuaaaagaaaggaccacaggcaucacgcgaucgaugcucuggucguggccuguacacgccagggcuauauacagcgacuuaacucguugaacagcgaagaggacucccugcagaugcaagaggacucaaaacagaugagagaaaagaugggagggcagaagcggcccaccgcagauaaacacaguaucuuagagaauuggcucauucugcaaccacauuuuucucaccaggaaguuaagagcaaaguggccgagauccuuguauccuucaggcccggcaagcgcacggucucaaccggucguaacacauaccugagaagcgggaaaaaggugacucagucuggcguucuaauuccucggggaccacucuccgaggaaagucuguacggccagaucuugaggaauggggagccgaccuaugugaaaaaggucgcucuggagagcuuaucugaagcccaaauagaacagauuguggaccccaagcuccgccgagagaugguagcaagaacacagccuuccgagggagcuaaacugaacccaaaacuucuguuggccacucccuuuuacucagaugcggccggcacccagcgggugaggaguguucgcgucgcuaucgaaaaugguaaaaacagcaucgugccucucagauauaaugagucggggaaggcaauuacauucgugaacccaggaaauaaccaucacgucggcaucuacaggaccuccgaagguaaacugguugagucuugcgugacuuuuuggcaagccguggaccggguacguuauggcauucccacgauaauccgcaagccgcgagaaguccuagaucagcugcuucucagagacgauauuccugaggcucuguuggcccaucugccagcaagcgacugggaguucguggaauacuuacaggcgaaugagauguuucucaucgggcugacagaugaagagauucagaccgcccuugcugaaucagaccuguugacucucaguaaccaccuguauaggguucaaaagauguccucugaguacuacguguuccgguaucaccuagagaccgaagucgccgauaauaaaaacaauacaggaaucauacccaaguuuuaccgccugagaggcccuaacgacaccuaucuuaaagcaaaccccaggaaggugaaaguuaaucuccugggggagaucagcuugccauga

SEQ ID NO: 2878 - RNA, 3615 nt, Artificial Sequence
  Cas9 variant
auggagagaauccugggcauugacaccgggacaaacagccucggaugggccauaguggauaaggacgaaaaucaguaccaccuugucgcuaaagguacuaacaucuucuccgagggcguuaagauugaaaaagggaucgagucuucaaaggcagccgaaaggacggagcaucggagugugcgcaaacacuauuggcgacguaagauuagaaagaucaggcuguugaccauauuaagcgauaaugaccugugcccccggcuaaaacaugagcaacuccgccaguggagacugaagaaaguauacccuacagaugacacuuuuauggaauggcagaggaccgaggauaaggcucaggugaacccauauaaauuccgguacaucugucuuacacaaaagcuggacuuguccgauauuacccagcgcuuuauccucggacgagcgcuguaucaccugaaucagagaaggggcuuccucucuaaccggaaggaagccacuaaagagucggaggguacagucaaggaagggauuucaagccugaguaaagacaugaaggauuccggaugcgaguaccugggcgaauauuuuuaccagcuuuaccaacagggcaaaaagauccguaaucauuauaccgcacgcaaagagcacuacuugaaggaguucaaggccauauguucuaaacaggaacuggacgaugcucuaauugagaagcucgaaaaagcaaucuuugaccagagaccguuaaagagccaaaaaggacagguggggacgugcacuuucgagaaggguaaguccaggugucccucaagucacccucuuuaugaagacuuucggauguacagcuucauuaacaauaucaaaguucagguggauacccuguaugacaagggcgagcgaucuuugacagaugaagagaaacaacucaucauuccacuguuuaagcgcaaauccaagagaacuuuccccuuugaggacauagccaagaaaaucgcugggaagaacaauuacugcuauauuaaaucaaacgaagagaaggccuacaaauucaauuaccagauggauacccaggucagcggaaguccugugaacgcgcaguuagaagagaucuucggcgaagacuggcugucuuccguaugugagguuuauacacucgcaaauaacaagagcagguuucaaauaaugaacgauguguggcauguccuuuucuuuuacgacgaugaggacaagcugaaagaguucgccaaggaucgguugcagcuagacgacgaacuggcugaaaaauuuucgaagauuucuaucccaaaugauuaugccgcacucucccugaaagcuauccgcaagauuaugcccuaccuuagagacuauggucugaucuacucagaggccguguucuuggcgaaccucguggauguccugccucagcacguuugggggauuaaagagaugagggaagccgcaauagagaaugugaucgacguaaugcauaguuaugauaagaacaauauugacggaaucaccuuagaaggcugcgugaagacguuucugaaagagcguuaccaggucagcgaugacaaccuaaagaaacucuaccacccauccaugcuggauccguauccccggcaacgaccuaaugacgaaggcguguuccagcuugggucuccaagaaucagcucaguuaagaaccccauggcuaugcacaguuuguuuaggcugcgcaaaguggucaaucucaugcugaagaagggauacauuacuccugauacaaaagugcauauagaguucucccgggaccuuaacgaugccaauaagagaugggcuauccagaccuggcagagggagaacgaaaaagagcgcgaacgaugucggaaggagauugaaaaauauaucgccagcccaucugacacugacauucugaaguaccaauugugggaggagcagaaucacaagugccucuauacaggugaugaaauccguauaaccgacuuucugggcgauaaccccaaauacgacaucgagcauacgauuccgagaucagcagggggagauaguaccaagaugaauuuaacacuguguagcuccagguucaaccgcgacgaaaagaagacuaaacuaccugccgagcucguaaaccacgaugaaauccuggagcggauuucuaauuggaaggagaaguaugaagacaucgauaaacagauaagaaagauuucgaccaaaggcgcuacaagcaaggaggacaaagauuccaagaucaggcgacgccauuaccuuauuuugcagcgggacuacuggagagguaaauaucaaagguuuacuaugaccgaaguucccgagggguucucacgucgccagggcacagauaucagugugauaucucgguacgcgagaauguaucucaagagcgucuucaaacagguguacaucgucaaaggaauugcaaccuccgacuuuaggaagauguggggcauccaagacgaguaugccaaaaaggaacgagugaaccacguucaccauugcauugaugcuaucacuauagccugcauugggaaagcagaguacgacaagcuggccgauuaucggcaccaguacgacgauuaccuguuccagggaaagacgaaaccaacauuugacaagccuuggcccucauucgugaucgauaucaaacauauucaggacgaauuacugaucgcucacuaugccaaggauaaucuugagaaauuuaccaagaagaacuugcgcgguaaagacggcagaauuauaagggauaaguucgggaauaaacuccaaaugaagggagacacuagccggaacucucugcacaaugacaaauuuuacggcgcaaucaaccaugaaggugagauuaaguauguauaccgaaccaauaucgaggcgcuagaugcuaaguccauugggaacaucgucgacccaacagugagaaguauaaucgaaagcgccauugcaauccacggcucucugaaagccgcuauuaauaagggaaucuggaugaacgaggaaaaacauauacccauuaagaaaguucgcguguucaggaaugaugucaagaagccuaucgagcucaaagaccagcgugaucuguccgacaaggauuauaaacagcacuacuaugugaccaacgacggcaauuacaugaugcuuaucuuuucaaaguugaacaacaaagggcgggaaauuagacagcauguagugauaaauagucuggaggccacugagguuaucaagagccacaaaaggucgcaagucggaaagguggugugggaauccuacuauucuaaggaggguuucgauuuaauuuacaaacucaagagcggcacaaugauccugcuuuaugaaaacaaucgcgacgaggucugggaucuggacauucgaaacuugcagaaaagacucuacaucauaacgaagaugaaauaugaugggcggaucuacaugaugcaccaucaggaagcaagggagaagaaggaccuggaggaaaaaucaggaaguuuuaagauuaaugaggacuaucgcccacuaaucguuaacuccuacaaucaguucaacgcucuggugcaagaucucgacuuugaaauuaaugaucugggcgagauccguagacuuauauga

SEQ ID NO: 2879 - RNA, 3630 nt, Artificial Sequence
  Cas9 variant
augaagaaagacuacauccugggccucgauauugggauaagcuccgugggauggggucuucuggaguuggacgauaacaauaaccccuauaagaucauugacgucggcucuagaaucuucaccccuggggaaguugagaaaacaggagauucaagggccaaggaacggcgcgagaaacgaggcgcucguagaauugcaaggcggcgcgaauuuagauuagacagggugaagaaucugcuauacgagaacgguuaucucaaggggaauaucaacaguaauauaguaagcgagaaaaacgaagaacuguccaucauuuucaauaacaugaucaauaacuacuauaauggaaagaacacuaauccauacauucuuaaaguggaagcccuggaucggaaguugacggacgaggagcucucuaucauacugguccacuaugcgaaaaagcgcggcuacaagucgaaccgagaagaggcuucagauaaagaaagcggcaaggugcugaccgccauuaaagagaacgaaaagaucaugaaagacaauaacuacagaacaauuagugagauguauaucaaggaugacaaauuuaagaauaagaucaaaaacuccccgaaugauuacaagauuucuguuacuaacgagauguaucucgaagagauaaauaaaguguuagacagccagaucaaguucgggcugauuaccgacgauuuuaaaaaccaauaccuugaaaucuauaauuccaggcggucauacgcaaagggacccgguggcaacaguccuuaugggggagacuugauagagcguaugacaggcaagugcaauuucgaugguaacccacgcgcccccaaaagagcuuuuagcucugaaauuuacgucgcacugaccaagcuagugaaucucaaauacaagguaaacgacggggaguauaucaaacuguccgagaaggaaaucaagaauauuaucgagaaagccaaggaaaagaagucaauuagcuacaaagaucuuacuaagaugauaggaaacaacaucgacuucaaggaucugacauugaguaaaaaggaguauauuaaacucaucgaggagcugaagaaaaaguuaaauaucaaaaaggacaccaagauuaacauaaaugagcugucuuccgaagauaaagagcucuacaacaaacuuuguaaugacaaacuguugagcaagacgcuaaucgaacugaaaggcuaucauauucucaaggauucgguuaucaaggcuuacucuaaagacauuugggacgaggugaaggauaacauguaucugcuugacgaucuggccuuguacugcacuaauuacaaagucaacgaggacauccucaauaagauaaaagaauccgagaacaucgauaauauuuuuaacgacauccacuucguggaacuguuaccuaauuuuaaggaucaucugaugcuaucaaccgagcucauuaggaagcugaucccaauaauguauggcgggaacacauacgacaaagcgaugaauauucuuggauauaaccacagugauaucaacggugacaaggaaaagaaggauuugcuggugcccauuugugucgacgauaauaucacuaaccagcggguuauacgaagccucacccagacacgcaaagugaucaauuccauuaucaagaaguacggcaugccuaaaauuaucaacauagagaccgcaagagagcuggccaagucuaggcaggaacggaaugagauugcuaaaaacaauguagaaaagcaagccgagaacgagaaaaucaagaaucagcuuguggaacugggguuguucgucagcacggacaaaaucucaaguacugaccuccugaaguauaaguuauggaaagagcagaacgaauuuugcggauacuccaugaagaaaauuagcaucgaggaucuguucggcaauaacauugugcagauagaccauauccuaccauauucucgcacauacaaugauaacuaccucaauaagacccugguuuauacuaaagaaaaccaagagaaggguaacagaacaccguacgaaugguucgggaagaccgacaaaugggaugaguaugagacguacauuaauaaccuuaccaucucacagaagaaaaaggacaauuauuugcugaaaaagcucgauuuugacacagaaagggagaugcguagucagaaccugaaugauacuaaguacauuagcaaagaauuauccucucugaucaaggcauaucuuaacguggagaaagucaauauguaccccggcgcuauaaccgccaaguugcgggcgcgauggggauucaacagacucacacacucguaccugagcaaaaauuauauccuaccuaagaacauuaaggaggacaucaauaaagauagggacaaccaucugcaccacgccauggaugcacucgugauugcuuccaucacuccaucacugcagcaaaagauaacccuuuacgaaaaauuuagucgcuauauugacggcuugacagagcugcagaucaagaauaucucuuacauuaaaauagaagacagcgaggggcaguauuacaacgaugacaccgaugaaguagagacuaucgacauucgggaguauaucaagcaacaguuagccgaaaauaacauuuacuacaauagacauaacaucuccaagcucgaguucccccugccuuaugaaaacuuugauaaagaggcuaaacuuaggguuuacgaacaggaccuggauacguugaaauggaaucucaagucauauaacacauacacccagaaagacauagauaaugugcacacucugaucccaagcauugccaagaccaaagucucuggaaagaugcacgaggagacauauuacgguaucaaggaaauuggcaaagacgaggauaagaaaaucuauaagacccuacgcacucccauagaaaaagugaagcgaaaggaccuggacaacauuccggaucggcucgggggauccaaagacgucuacgagagucugguggaaugguucggcgauuacgagguuggugaggaagugcuuaaggcaaaugggaacaaauauccuguaagcaagucugacaaagagcauaaggaaaucaagaaauugaagcuguacuccgaguauaaaaauacaggccacaugaucaacaagucaaaugucgagaaaggaggcauuuaccguaucgauguguuuaagaguaaggacaaagaagaugacaaguuauauuucgccgcuuacgauauacucgagauuaaaaagaucaacacgcugaaagaaaagaauagaguugacgauaacuuuaauauuaaacuugacuaugggcaaggaaagaacagcaagaucaugucguacaccgauauaauuaauaacuacgaccuguauaucucccuaaacaaaaaugaccucaucaagauuacuacaaacgaugguaaagagucuguggcguacgucgugggcuguagcucagggaugcuggaaguaaagaguaaauugggagacggcuaugauaucauuaagaccgaccugaaugagaacaauauauucuccaagcagagggcacaguaccagaucacagugucuacuauuaaagagaucaagaaauuaagcaucuccguucucggugaaauuucagggcuguga

SEQ ID NO: 2880 - RNA, 3633 nt, Artificial Sequence
  Cas9 variant
augagaaccauccugggccucgaccuugggacaaacagcauuggaugggccgugauaaauuccgucaucaaggagcagacugaaaggauuuggaucgagauggcugguucucggauuauccccauggaugcagccauacugggcgacuucgauaaagggaacucaaucagucaaacggcggaacgcacccgauuucguggaguuagaagguugcgggagcgccaguuacugagaagggaacggcuacacaaggugcucaaaauucugggcuuccuuccugagcauuaccugaaggguaucgacuuugagaaacacacagggaaguucuugagcggauccgaaccaaagcucccguggguaaaagaucgcuggggcaaguauucuuuucuguuccagacugcuuuuaaugagaugcuggccgacuucgcaaaacaucagcccucgcucguguuugauggcaagaaaauuccuuacgacuggaccgucuauuacuuacgaaagaaggcccugacagaaaugaucucaaaagaggagcuugcuuggauauugcugaacuucaaucaaaagagaggguauuaccagcuaaggggagaagaggaagaggauaacgcagguaaaagcguggaauuuuaugcccucaagguucugaguguggaggcuaccgacgagaaaaagggccgggauauuugguacaauguccaccuugaaaacggguggguguaccgucgcuccucuaauguaccacuggacugggagggaagaguuaaagaauuuaucgugacuacagauuugaaccccgacggcaccccuaagcucgacaaguauggugaggucaaaaggagcuuucgggccccaaaggaagaugacuggaugcugauuaaaaagcgaacggaggcggauaucacugggacccauaaaacaaucggauccuacauuuaugacgcauuacugcaggagccccagcaaaagauaaucggcaagcucgugaaaacuguggaacgcaaguucuacaaagaggaacuuaauuucauucugcagaagcagugcgccuuucacgcugaguugcaggauagagaccuauauaugagguguaucgaagcccuguacccuggcaacgagguccaacggcgcaauauagcaaacagagauuucauuuaucuccugaucgacgauguucuuuucuaccagaggccacugaaaaccaagaagucauugaucgcuaauugcccguacgaggaaaacgaguaugugaaccguaaaacaggggaaauuaagaccgcccccuugaaauguaucgcgaagagucacccucuguuccaggaguuucgguuaugguacuuccugagcaauauucgaguauaucaaaaagagagagaagugaacggaacgcuacaucucgacgucgaugugacuacagaguuucugaagaccgaagacgacuacguugcccuuuucgauuggcucaauucuaggaaggagauagaccagaaagcauuucugcgcuauccagcuuucggucucaagaaagaaaucaacaauuaccgguggaacuauguggaggauaaguuuuaccccugcaaugagacuagacacgccauucuguccaggcuugaaaaagcuggcaucgggaucgacuuccugucagaugagaaggaaacagccuuguggcauauucucuacagcgucagugacaaacaggagauagaaaaggcacuggccaccuuugcugugaagaacggauuaaaugagucuuucguagagguuuucaaaaaguuuccuccauucaaauccgaauauggcgcguacagcgcaaaggccaucaaaaagcugcuaccccucaugcgcugugguaaguauugggauaugucgcugauugacgggacgaccaaagagcgaaucgaacggauuaucgcuggcgagugcgaugaaucuauaggagccaaggugcgugagaaagcaaugaaccuuuccgacaucucauguuuuaagagauugccgcuguggcucgccugcuacgucguguauaauaggcacagugaggauaaagaaauuacaaagugggagacuccugcugacaucgaugccuaccuggcagcguucaagcagcacagcuuacgcaaccccauugucgaacaagugaucaccgagacacugcggguugugagagacauauggaaacagguaggcaagauugacgagaucaggauugaacuugggcgagagaugaaaaauccagcugauaagcgcaaacggaugacuacccagaucuuggaaaacgagaaugccaaccucagaauaaaggcacugcuagccgaauuugucaacccugaguauggaguggagaauguuaggcccuacuccccaucucagcaagaaauccugcguauuuacgaggacgcugugcucaagggugaggaacagauccccgaagauauugacgucauccugaaaaaguucaacacaagcaaacuuccuaccaagucagaguuuuugcgcuauaaacugugguuagagcagaaguaccggaguccauauacuggcgaacucauaccgcuggccaaacuuuucacggcagcuuacgagauugaacaugugaucccccaguccagauauuuugaugacagcuucucuaauaagguaaucugugagucagccgugaacaagcugaaagauaaucaauugggguacgaauuuauuaagaaccaccauggacagaaaguugaggucggcuucgguaagacaguggagaucuuuaguguggacagcuaugaaagguucgucaaagagcaguacgcgaaguccgggauuaagaugaaaaagcuccugauggaugacauaccugaacaguucaucgagcgacaacuaaaugauucucgguacauuucgaaaguugugaagggccugcucagcaacaucgugcgcgagaaaaaugacuccggagaauaugagccagaagccguaucaaagaacauucuggucugcaccggcagugugacugauagacuuaagaaagacugggggaugaaugacguuuggaacucuaucgugagccccagguuugagcgguugaaugcucugaccgaaacacaguguuucggacacugggagaacaaggaugguaaaaaggucuuucagaccgcagugccuuuagaguaccaaaaaggcuucuccaagaagcgaauagaccauagacaccacgccauggaugcuaucguuauugccugcgcaacucgcaaucaugugaacuaucucaacaaugaaucagcgagcaggaacgccaaaaucucucguuacgaccugcagcggcuucugugcgauaaguccagaggggacggaaauggcaacuauagguggauuaucaaaaagccauggacaacguuuacccaggaugcucgcgaggcccuaagugguauaauuguaagccucaaacagaaucugcgaaucaucaacaagacuacaaauauuuaccaacacuucgacgcaaacgggaccagagucuaugaaaagcagaaaauaggcgauucuugggcuauccggaagcccaugcauaaagacacaguguuuggagccgugaauuugaggaaggcacugauuccgcagcacuacaacuuaacucucuucaucuccucauga

SEQ ID NO: 2881 - RNA, 3642 nt, Artificial Sequence
  Cas9 variant
auggagaagagacugggcaucgacguggggaccaacagccucggaugggccauugucgaaguugaugacgaggguugcacacuucuggauaggggcguggacauauuccaggaagggguagcucgggagaaaaaucaagaaaagcccgcagugcaggaucgcacugacgcccgagcguugcguagacacuacuuuaggcggcgcuuaagaaaaaucgcucugcuaaggguccucgugcggcaugaucuguguccugcccuuuccgaggagcagcugaacgcauggcagggaaagggcauuuauccauuggacgaugccuucauccgcuggcaacgaacggacgauaaugcugacagaaacccguacagggaucgguuucguugccucaccgaagaacuggaccuggcaugucgcgaagagagauauguucucgguagggccuuauaccaccugugccagcggcgaggguuccuuucuaaucgcaaagacgcuggaaacgaggccgaagagggcaaggugaagcaggaaauuaaaacauugucagcggauauggcagccgcuggcugugaguaucugggggaauacuuuuauagacuauaccagaggaaggagaaaauccggaagcauuacacugcccgcaaugagcacuaucucgcagaguucagagcuauaugcaggaaacaacgucuggacgaggaacuucggcaggcccuggagaaggcgaucuuuuaccagcgacccuugaagagucagaaaggacucgucgguaaguguaccuucgaaaaagauaagagcagaugcccugugucccauccaagguuugaggaguuccgcaugcugcaauuuauuaacaauguacggguuacaggccccggggacgccgaaccuagaccauuaucucccgaggaaguggagaucgucaggccucuguuccuccgcaaaucgaagccacacuuugauuucgaagacauugcuaaaaagaucgcaggaaagggcaacuaugccugucgaggugagcuucugcaggcuccguaccgguucaauugcgccgggaaaucaaccgugacuggaagccccgugagugcauuguuugccuccgucuucggcgaugacuggcagcgugagauauguucucuauauacacugggcgcugggaagaacgaggagcaaauucucaaugauguuuggcacgugcuguuugcguucgaagacgaggagagacuucaggcauggcugcaggaaaaauugcagcucagcgccgaugacgcuaagacccuggccgcauuuagguuaccucaaggauacgccucccugucacuaaacguaaucaauaaaauucucccauaucugcgccgggguuacagauacgacgaggcuguguucuuugccaaccuuggcaaggucuugcccgcagaaguguaugcggauccugcuaggcgacgcgagguugaacaggggaucagugcccagauggacgaucugggagacggcgagaagacgcggaaagaggaaagaaucagggauuaccuccgucgcuauugggguguggaggaaaagcggcuggagagacuuuaccauccaagcaugauugaagcauaucccucugccuccccgaacgggcagggccuguugcaacucggaucaccuaggauacccgcuguccgaaauccaauggccaugcgggcacuguuccgcuuaagagugcugcuaaacgagcuccugagggagggcaaaaucgaccgggggacuaagauuaauaucgaacuugcucgagaguugaacgaugccaauaaaagaaaggcgauagaacgcuaccagagggagcgugaagccgagaaccggaaguaugcugaggaaauuagacagcaguacguagaggcaaccggacacagcaucgaaccuagugaggaggacauccugaaauacaggcucuggguugaacaaggucauugcucucuguauacaggcaagacuauugggaucuccgaguuuuuaggagauggccgccgauacgacauugaacacaccgugcccagaagccgggguggggaggaugcccaguauaauaaaacacugugcgaagaggaguucaacagggacauaaagcgcgauaaacuuccaucggaauuggcuaaucacaccgccauccucgcaugugucgagucuugcggcugguuugaacguauugagggacuggaacauagaguguggggcgcggaccggagggccaaguccgcuacgacuaagucagccaaagacuucgcaauccaggaucgccacuacuggcgaaugcaucuagacuauuggagacggaagugugaggcuuuuacaaugaccgagguccccgaaggguucaguaacaggcagggaguggauguugguaucauuggccgcuacgccagacuguaucuccaaacuguguucgacaggguauacacagucaaaggggcaaccacggccgcuuuucggcguauguggggacugcaggaggaauacgcggccaaggagcgcgugaaucacguucaucacugcauagaugcaaucaccauugcuuguaucggcagccgagaauaugcccuuugggcccaguacgugagacaagacgaguuguauagguggggugaggcugauaaaccucggugcgggaagccauggccgacauucacugaagacguccgcgcaaccgccgaugagcuguuaauuucccaccauacacccgacaacaugccuaaacagucuagaaagaggcuccgggugcgaggcaagguacagagaaaugaucgcggagaagugaaauacaugcagggcgacacugcgcgaggggcucugcaccaacagaccuuuuauggagccaucgagcgggauggcgagauacguuacguugucagaaagagccuugaccagcuguugccagcagacguggagaaaaucguggaugaagccgucaggcagaagguucgcgaagcuguggaggcauaugguuucaaagaagccacagaccccaccaagcauacuguguggaugaacgaggagaagcaaauuccuauccggaaaguaaggauucucacgggggucaagaauccaauccugcuaaaaccccacagagaugugucaguuaaggaauacaaaagguacuaucacguggucaacgacggaaacuacuguauggcgauauaugagggccgcgaucggcaggguagacugaagcguacauuugaaauugugaauaagcucgaggcugccagguacuucaaacggagugcagaccgcgaaucccgaccggaucugguuccucuuagcgacgugaacggcuauucuuugaaguaccuguuaaaaaccgggacuaugguacucuuuuaugaaaauucaccagaugagcuguacgaaugcagugucggagagcuugccaagagacuguacaaaguggugggcauggcucaggacgggaggguccaguuccuauuucaucaagaagcccgggaucagaaggcaguuaccgcugaguguggaaugggcaucagcguguucgacgcccgccaccccgcgccuaagcucagaauuaggguauccaacuuuaaaauguucguggaagguuaugacuuugagcugacagucaccggggaggugaaguucaaacgauga

SEQ ID NO: 2882 - RNA, 3642 nt, Artificial Sequence
  Cas9 variant
auggagaagagacugggcaucgacguggggaccaacagccucggaugggccauugucgaaguugaugacgaggguugcacacuucuggauaggggcguggacauauuccaggaagggguagcucgggagaaaaaucaagaaaagcccgcagugcaggaucgcacugacgcccgagcguugcguagacacuacuuuaggcggcgcuuaagaaaaaucgcucugcuaaggguccucgugcggcaugaucuguguccugcccuuuccgaggagcagcugaacgcauggcagggaaagggcauuuauccauuggacgaugccuucauccgcuggcaacgaacggacgauaaugcugacagaaacccguacagggaucgguuucguugccucaccgaagaacuggaccuggcaugucgcgaagagagauauguucucgguagggccuuauaccaccugugccagcggcgaggguuccuuucuaaucgcaaagacgcuggaaacgaggccgaagagggcaaggugaagcaggaaauuaaaacauugucagcggauauggcagccgcuggcugugaguaucugggggaauacuuuuauagacuauaccagaggaaggagaaaauccggaagcauuacacugcccgcaaugagcacuaucucgcagaguucagagcuauaugcaggaaacaacgucuggacgaggaacuucggcaggcccuggagaaggcgaucuuuuaccagcgacccuugaagagucagaaaggacucgucgguaaguguaccuucgaaaaagauaagagcagaugcccugugucccauccaagguuugaggaguuccgcaugcugcaauuuauuaacaauguacggguuacaggccccggggacgccgaaccuagaccauuaucucccgaggaaguggagaucgucaggccucuguuccuccgcaaaucgaaacuucacuuugauuucgaagacauugcaaagaagaucgcuggaaagggcaacuaugccugucgaggugagcuguugcaggcuccauaccgguucaauugcgccgggaaaucaaccgugacuggaagcccggugagugcacuauuugccuccgucuucggcgaugacuggcagcgugagauauguucucuguauacacucggcgcugggaagaacgaggagcaaauucugaaugauguuuggcacgugcuuuuugcguucgaagacgaggagagacugcagaccugguugcaggaaaaacuccagcugagcgcagaugacgccaagacguuagcugccuuuaggcugccccaaggauacgcaucccuaucacucaacguaaucaauaaaauucugccuuaucuucgccgggguuacagauacgacgaggccguguucuuugcuaacuugggcaagguccugccagccgaaguguaugcagaucccgcgaggcgacgcgagguugaacaggggaucagugcucagauggacgaucucggagacggcgagcagacucggaaggaggaaagaaucagggauuaccugcgucgcuauugggguguggaggaaaaacggcuugagagacuguaccauccuagcaugauugaagccuauccaucugcaucccccaacgggcaaggcuugcuccagcugggaucaccgaggauaccugccguccgaaaucccauggcuaugcgggccuuauuccgccugagagugcuacucaacgagcugcuuagggagggcaagaucgaccgggggaccaaaauuaauaucgaauuggcacgagagcugaacgaugcuaauaagagaaaagccauagaacgcuaccagagggagcgugaagcggagaaccggaaguaugccgaggaaauuagacagcaauacguagaggcuacaggacacagcaucgaaccaagugaggaggacauccucaaguacaggcuguggguugaacagggucauugcucuuuauauacuggcaaaaccauugggaucuccgaguuucugggagauggccgccgauacgacauugaacacacagugccuagaagccgggguggggaggaugcacaguauaauaagacccuuugcgaagaggaguucaacagggacauaaaacgcgauaaguugcccucggaacucgccaaucacacggcuauccuggccugugucgagucuugcggcugguuugaacguauugagggacuagaacauagaguguggggcgcagaccggagggcgaaauccgccacuacaaagucagcuaaggacuucgccauccaggaucgccacuacuggcgaaugcaucuggacuauuggagacggaaaugugaggcauuuaccaugacugaggucccagaaggguucaguaacaggcaaggaguggauguugguaucauuggccgcuacgcuagacucuaucugcagacaguguucgacaggguauacaccgucaagggggccacgaccgcagccuuucggcguauguggggacuucaggaggaauacgcugcgaaagagcgcgugaaucacguucaucacugcauagaugccaucacaauugcauguaucggcagccgagaauaugcuuugugggcccaauacgugagacaggacgagcuguauaggcggggugaggccgauaagccccgcugcgggaaaccuuggccaacuuucaccgaagacgucagagcuacagcagaugaguuacucauuucccaccauacuccggacaacaugcccaagcagucuaggaaacggcugcgagugagaggcaagguacagcgcaaugauaggggagaagugaaguacaugcaaggcgacaccgccagaggggcgcuucaccagcagacauuuuauggagcuaucgagcgugauggcgagauaagauacguugucaggaaaagccuggaccaguugcucccugccgacguggaaaagaucguggaugaggcaguccgccaaaaaguucgggaagccguggaggcuuaugguuucaaggaagcaaccgacccaacuaaacauacgguguggaugaacgaggagaagcagauucccauccgaaagguacggauucugacaggggucaaaaauccuauccuacugaagccacacagggaugugucaguuaaagaauacaagcgcuacuaucacguggucaacgacggaaacuacuguauggccauauaugagggccgggauagacagggucgucucaaaaggaccuuugaaauugugaauaagcuggaggcggcucgguacuucaagcgcagugccgaccgagaauccagacccgaucuuguuccguugagcgacgugaacggcuauucucugaaauacuuacucaagacugggaccaugguacuguuuuaugaaaauucaccugaugagcuuuacgaaugcagugucggagagcuggcaaaaaggcuauacaagguggugggcauggcccaggacgggcggguccaauuccucuuucaucaggaagcucgcgaucagaaagccguuacagcagaguguggaaugggcaucagcguguucgacgcuagacacccagcccccaagcugaggauucgaguauccaacuuuaagauguucguggaagguuaugacuuugaguugaccgucacuggggaggugaaauucaagcgguga

SEQ ID NO: 2883 - RNA, 3651 nt, Artificial Sequence
  Cas9 variant
augaccaagauccugggcauugacacagggacuaacagccucggaugggccauaguggauaaaacggcugacaauuacaaccuucuggauaagggugucaauaucuuccaggagggcguuaaaauugaaaaggggaucgaguccucuaaagcagccgaaagaaccgagcacagggcgacacgggugcgcuauuaccgaauuaaguugcguaagaucagauuacugaggauacuaucagacaaccaucucugcccaccucugagucaagaagaacuuagcacuuggcggcugaaaaagguauaucccaaaaaugaguuguuuaugcaguggcagcgcaccgaugacgauacagaaaagaccccguacgcuuauagacacaaauguauccaugagaagcucgaccuguccgaugugacugacagguacauucugggacgggccuucuaucacaucauucagcgccgaggcuuucucucuaacagaaaggaacaagguggggaggauucgggaaaagucaaggagggcaucucaacauuaacccaugaaaugaaugaggcaggcuacgaauaccugggggacuauuucuacgcccuuuauaacaaaggagagaagauaaggaaacacuacacggcucggaaugaacacuuuuugagcgaguucaaggcaauuugcgagaaacaggaucuggaaaaggagcuagguagugaagugguucguaacaucgagaaggccauuuuugaccagcgcccccucaaaucccagaagggccaaguggggaaaugugucuucgaaaagaauaaaacuaagugcccuucuagccauccaauguaugaggaguuuagaaugcugaccuucaucaacaauaucaagauuaaaacacccaacgacgaugugcuuaggccucugaauacuggagaacgggagaagauaaugccauuguuuuuccgaaaauccaagaaacaguuugacuucgaagauaucaccaagaagcucgcucccaaaaagauguacggcuucuauaaaaaggaggaagacgccgagaugccuuuucuguucaacuacccaauggauacaucaguaagugguuguccgguuaccgcggcauuaaaagacguguuuggggaugacuggauuacggccaucugcgagacuuacacacugggagaaggcaagagccgcuucgauauagucaacgacauuuggcacgcucucuauuuuuacucugauaaggacaaacuugccgaguucgcaaucaauagacugcaguuguccgaagacgaggcuaagaucuuuucagagauuagccuacccgccgauuaugcgagucugucucucaaagccaucuguaagauucugccuuaccuuaggcggggccugauauauucccaugcaguguucuuggggaaccucugcgaagugaugccaaaauacgaguggagcaucaaggaaaugcgcgagaccauuaucgacaauaucauuauggaaauggauaaaugugacacuaaggauaagagaacauuugaggucugcauaaaagacuaucugaagggacaguacaacguuucggauaauucucugaaaaagcuguaccaccccuccaugaucgagaccuauccuagggugcaauacacgaacgaacacgguguauaucagcuaggcucaccacguauugacagugugcggaaucccauggcuaugcgaagcauguucagacucaggaaacuggucaaccgccuuuugguggaggggaagaucgaucagaauaccgaaguucauauugaguuugcccgggaacugaacgacgcuaauaagagaaacgccaucgcacucuucgugaaagagaaucaauccgccaacgaugaggcuaggaagcagauaaucacacuguuuaaaaaggaaacuggaaccgacauugagccgacagauaaagacauccuuaaguacguccugugggaggagcagaaucacauuuguuuguauacuggcaagcagauccgcauaucugacuucauuggugcgaacccuaaauucgauaucgaacauaccauuccccgaagcguagggggcgacucaacaaagaugaaccucacccugugcgauagucgguuuaaucgugaggugaaaaagacuaaauuaccaguugagcugccuaaccacgacgaaaucauggagagaauaaaggaauggaagaaaaauuacgagcuacucgauauccaaauuaggaagaacaaaaagcuguccaaaggagcaacgacaaaggagcagaaagacaccaucauucgcaagcggcaucuuuuggaacugagaagggauuauuggcgaggcaaguacgagcgcuucacuauggaaagcgugcccgagggguuuucucggagacagggaaccgacaucucagucauaaguaaauacgccaggcucuauuuaaagagcuuauucaaucguguguacacagucaaagguauugcuaccuccgauuuucgcaagaucuggggcauccaggacauuuauucuaaaaaggaacggaucaaccacgugcaccauugcauugaugccauaguuaucgcauguauugggcuggacgaguacaauaaacuuggagccuauuaccacgaugaggaaaacaauaaaugguauggcaugucgaaggcuagcuucaaaaagccaugggccacuuuuguggaggacaucaaaaagauucaagacgaaaucuugguauaccauuacacacccgauaacaugccuaagcaggguagaaggcgaauaaaaaucgacgggaagaaaauucucugcaagggcgaugcagcgcggggaucccugcacaaugacacguauuacggcgcuaucgagaacgauggggccgucaaauaugugaagcgcauugaccuagcaucacuggaagagaaggauguuaaaaauaucguggacgauaccgucagaaguauaauugaggccgcuaucaaggaaaaaggauucaaggacgccauggcaucuacuaucuggaugaacgaggaaaagagggugccaauuaagaagguacgguguuuuacaccgagcauaaccaaaccccucaauauccgaaagcagagagauguguccauuaaagaguacaagcagcaauaucacguugcuaacgacucaaacuaccugcuugccuuguauaucgguacagacaauaaaggcaaggaaaaacgcgaguucgagauugucaacauccugcaggcggcccaguacuacaggacuagcaaugauaaggaagugguggaccgucauauagucccuaucaagucugagcacgauuauccauuugcuuacaccuuaaaaauugggacgaugguucuccuguaugaaaagucccccaacgaggugugggacgcaaccaucaaagagcggaauagaaggcuuuacaaggugacaggacugaguacuaugcgcaugaaaggccgaaacggugaauaugccuacgcuaccguaaaguugauucauaaugaggaagccagaccuagcaaggauaucaaagcaaagaacggggaguaugaacagggcgaggaguuccggccagcgauaauuaugcuccacacacaacugaaugcccuaguccagggauacgacuuugaaaucaacgagcugggcgaaaucaggcgccuccguuga

SEQ ID NO: 2884 - RNA, 3654 nt, Artificial Sequence
  Cas9 variant
auggagaagcagagaauccugggccucgaccccgggaccaacagccuuggaugggccgugcuggauuucgacaauuccaaacaagaauacaacuuggucaggaagggugagguuauuuuugaagagggcguggggaaaucugaacggggagaguucucaaaggcugcauaucgcacauuuuacaaaaguacucgaaagcacuauuuccguagaagguuacggaagauagagguacugaaagugcuagucaaguacgauuuuugcccuuaucucagcgacgaucugcuuaaacaguggcaugaaaagaaaaucuacccagccgugaaggaguucauggacuggcagcgcacguccgaugcggaaggcaagaauccguauuacgacagacacuguugccugaacgagaaauuggaucucucucugaagucggacagguacauucugggucgggcucucuaucauuuaacccagcgccgaggguuuaaaucaaauagacugauccaaaacaaugaugagaacgaagagggaaagguuaaaaagggcauuagcgaacuuaguacagagaugcaggaagccaauuguaacuacuugggcgacuauuucuacaaacuguauacugagaaggggaauaccgugcagaucaggaagcgguacacagaucgugagaaacacuauaagaacgaauuuaaugcaauaugcgagaaacaggaacuaaacgagaccaucgucaaggaacucgacaaagccauuuucuuucaacgcaagcugaagccccagagacauggaguggguaaauguacuuucgagccuaauaacaggcggugcgcuaucucccacccagacuuugagcgauuccgcaugcuuuguuucauuaacaauaucaagauaaaaacacccuuugaagagaaccugagaccuuugaauaacgaagagaaggcacucauugaaccacuguucuacaggaaaucuaucaagaauuuugauuucgaggagauugccaagaaauuagcuggcaagaacaauuacugcuauaucaaagacgauagcuccaagcaguacaaauuuaacuaucggaugucacagggggccaguaccugucaaacgaucgcgaagcucaagagcauuuucggagaagaguggaaaaauggcauagcagaaacuuacaccaaccgcagaaagaaagagggucucaagaaacaggccgagaugguagacgauaucuggaauguucuuuauucuguguccgaaugcgacguccugaaggauuuugcuauuaacaaauugcagcuagacgagaagacagccgauaauuucucaaagacuaaacuggcacaaggguuugcuacccucagccugaaggccaucaggaaaauacuucccuuccuggaacagggauuuggcuacacagaggcgguguucuuggccaacauuccuaccguggucggcaaggaauauuggaauaacgaggacauccguaacgauaucauggaggaaauuaaaacgaucuuuuaccacaauacucucaagacaaacgacagucauaauaccauucuguucuguauaaaggacaucuuaucuaacaauuucgaucuggcaccaggggcuauugacaaacuauaccacccguccaugaucaacguuuauaaggaugugauccccaaugaggacgguauucuccagcugggaagcccuaaaauagaugccguaaagaacccaauggcuaugcggucgcuucauaucauucgaaaaguggucaaugaauugcugagagagggcaucauuaacucugacacugaagugaggaucgaguacgcccgcgagcucaaugaugcaaacaagcggcacgccauagcugacuggcagaagaaacaauaugggaagcaccagaaauacagaaaggaaaucaaagagcuguuuaaggcggaaacaggauucgagauugaacccaaugagaccgauauccuuaaguuugagcugugggaggaacagaaccauauuugcuuguauacgggccaggaaaucgguauauccgaguucguuggggagaauccuaaauacgacauugaacacaccuuuccaaggucacucggcggagauaguacaaagaugaacaugacucugugcgagaacaaauucaaucgcgaaaacaagcaaaagaaauuacccagcgagcuggcaaaucauuccgaaauccuagagcgaauugacgauuggaaaaagaagaucuauauacuccagaaaaaguacgacucuauccggacccacaacggcauggacaaagagaauaaggauaaaaagauugugagccgucauaagaucaaacuggaacuugacuacuggaaggggaaauauaacagauuuacaaugacugagauuccggaaggauucucaaggcgccaggguaugggcaucggguugauaagucgguacgccggacuguaucucaagaccauuuuucacaaaaaggauaauccucagaaguccaacgucuacaucgugaaaggcagcaucacagcugaguucagaaggauuuggaauauccaagacgauuaugaaaagaaaugucgagacaaccacauucaucacugcauagaugccaucguaguugguuguauugggaagcgcgaguacgaccugauggcacaguuuuaucgggaugaggaaaaauacagaugggagaagaagaaaaagcccuucuuuaaaaagccaugggaaaccuucacucaggacauguuaucucugaaagaugaggugcuuacgguccauuucaauccuucaaacuuuacaaagaaggcccacaaaaagguguucacccccaaaggcaucuuugucgcucagggagacugcgccagggugaaguugcacaaaggcaguuacuucggggcaauugaacaaaagggagagaucaaauauguuaugcguaaggagcucagcgcgcugaagauagaagauaucaaaaauauuguggacgcuguagucaaggagaaagugcuagccguugugaagaaaaaggguuuuaagcaggcaauggccgaaccaaucuacaugaacgaggacaaacgcauucugaucaagaaaguccggcuguucgugucccaggcuaauccccugauaguaaagaaacauagagaucuuucuucgaaggaguauaagcaaaacuacuauguggacaacgaaggcaauuugaugauugccauguacgaggggguuaaaaagaacggaaaaaucgauagggaaaucacugucgugaauaaccuggaggcagcuaaguuuuuccgacagagccagaaaaauaacgccgaaaagcaguuaauuucccaccucucaccuaagaauggcuauccacugaaaaccgugcuuacacaaaagcagcuggucuugauguacgaggacaguccgaaagagauaaagcuccgggauaccaaaaacaugguuaagcgccuguaccagguguuugguaucgaaaaagacgggagagugaagcuaaaguuccaucaggaggcgaggucugaaggccugaauauuaacagcgccgcuuuuaaaauccaagauacucccgagucccucuaucggcacacaaagucaaaucugaaaguacuugucaacggaguggacuucaagauuaauaucuugggcgaaauaagccugaucuga

SEQ ID NO: 2885 - RNA, 3654 nt, Artificial Sequence
  Cas9 variant
auggagaagcagagaauccugggccucgaccccgggaccaacagccuuggaugggccgugcuggauuucgacaauuccaaacaagaauacaacuuggucaggaagggugagguuauuuuugaagagggcguggggaaaucugaacggggagaguucucaaaggcugcauaucgcacauuuuacaaaaguacucgaaagcacuauuuccguagaagguuacggaagauagagguacugaaagugcuagucaaguacgauuuuugcccuuaucucagcgacgaucugcuuaaacaguggcaugaaaagaaaaucuacccagccgugaaggaguucauggacuggcagcgcacguccgaugcggaaggcaagaauccguauuacgacagacacuguugccugaacgagaaauuggaucucucucugaagucggacagguacguucugggucgggcucucuaucauuuaacccagcgccgaggguuuaaaucaaauagacugauucaaaacaaugaugagaacgaagagggaaaggugaaaaagggcaucagcgaacuuaguacagagaugcaggaagccaauuguaacuacuugggcgacuauuucuacaaacuguauacugagaaggggaauaccguccagauuaggaagcgguacacagaucgugagaaacacuauaagaacgaauuuaaugcaaucugcgagaaacaggaacuaaacgagaccauagugaaggaacucgacaaagccaucuucuuucaacgcaagcugaagccccagagacauggaguagguaaauguacuuucgagccuaauaacaggcggugcgcuauuucccacccagacuuugagcgauuccgcaugcuuuguuucaucaacaauauuaagaucaaaacacccuuugaagagaaccugagaccuuugaauaacgaagagaaggcacucauagaaccacuguucuacaggaaaucuauuaagaauuuugauuucgaggagaucgccaagaaauuagcuggcaagaacaauuacugcuauauuaaagacgauagcuccaagcaguacaaauuuaacuaucggaugucacagggggccaguaccugucaaacgaucgcgaagcugaaaagcaucuucggagaagaguggaaaaauggcauugcagaaacuuacaccaaccgcagaaagaaagagggucucaagaaucaggccgagaugguugacgauauauggaacgugcuuuauucugucuccgaaugcgacgugcugaaagauuuugcuaucaauaaguugcagcuagacgagaaaacagccgauaacuucucaaagacuaagcuggcacaaggguuugcuacccucagccugaaagccauuaggaagauccuucccuuccuggaacagggauuuggcuacacagaggcgguguucuuggccaauauaccuaccgucguuggcaaagaauauuggaacaacgaggacauucguaaugauaucauggaggaaaucaagacgaucuuuuaccacaacacucucaaaacaaaugacagucauaacaccauucuguucuguauuaaggacauauuaucuaauaacuucgaucuggcaccaggggcuaucgacaagcuauaccacccguccaugauuaauguguauaaagauguaauccccaacgaggacggaauccuccagcuggguagcccuaagauugaugccgugaaaaauccaauggcuaugcggucgcuucauauaauccgaaaggucgugaacgaauugcugagagagggcauuaucaauucugacacugaaguuaggauugaguacgcccgcgagcucaacgaugcaaauaaacggcacgccaucgcugacuggcagaagaagcaauaugggaaacaccagaaguacagaaaagaaauaaaggagcuguuuaaagcggaaacaggauucgagaucgaacccaacgagaccgauauucuuaaguuugagcugugggaagaacagaaucauaucugcuuguauacgggccaggaaauugguaucuccgaguucgugggggagaacccuaaguacgacauagaacacaccauuccaaggucacucggcggagauaguacaaaaaugaacaugacucugugcgagaauaaguuuaaccgcgaaaauaaacaaaagaaauuacccagcgagcuggcaaaccauuccgaaauccuagagcgaauugacgauuggaagaaaaagaucuauauacuccagaagaaauacgacucuauccggacccacaauggcauggacaaggagaacaaagauaagaaaauugucagccgucauaagaucaagcuggaacuugacuacuggaaagggaaguauaauagauucacaaugacugagauuccggaaggauuuucaaggcgccaggguaugggcaucggguugauaagucgguacgccggacuguaucucaaaaccauuuuccacaagaaagauaacccucagaaguccaauguguacaucguaaagggcagcaucacagcugaguuuagaaggauuuggaacauccaagacgauuaugagaaaaagugucgagacaaucacauucaucacugcauagaugccaucguuguggguuguauugggaaacgcgaguacgaccugauggcacaguucuaucgggaugaggaaaaguacagaugggagaaaaagaagaaacccuuuuucaagaaaccaugggaaaccuuuacucaggacauguuaucucugaaggaugagguccuuacggugcauuucaacccuucaaauuucacaaagaaggcccacaagaaagucuuuacccccaagggcaucuucguggcucagggagacugcgccaggguuaaauugcacaagggcaguuacuuuggggcaauugaacaaaaaggagagaucaaguaugugaugcguaaaaagcucagcgcgcugaagauagaggauaucgaacauauuguagacgcugucgugaaagagaagguucuagccguggucaaaaagaaagguuucaagcaggcaauggccgaaccaaucuacaugaacgaggacaagcgcauucugaucaaaaaggugcggcucuuuguaucccagacuaauccccugauagugaaaaagcacagagaucuuucuucgaaagaguauaagcaaaacuacuauguugacaacgaaggcaauuugaugauugcuauguacgagggggucaagaaaaacggaaagaucgauagggaaaucaccguggugaauaaccuggaggccgcaaaauucuuucgacagagccagaagaauaacgcugaaaaacaguuaauuucccaucucucaccuaagaauggcuauccacugaagacaguccuuacccaaaaacagcugguuuugauguacgaggacaguccgaaggagauaaaacuccgggauacuaagaacauggugaaacgccuguaccagguguucgguaucgaaaaggacgggagaguagagcuaaaauuucaccaggaagccaggucugagggccugaauaagaacagcgcggccuucaagauucaagauacacccgaaucccucuaucggcauacgaaaucaaaucugaagguccuugugaacggaguugacuuuaaaaucaauauuuugggcgagaucagccugauauga

SEQ ID NO: 2886 - RNA, 3654 nt, Artificial Sequence
  Cas9 variant
augaaguacaacuaugugcugggccucgacaucgggauuagcuccgucggauggggucuucuggccuuggaugagaauaacaaucccuacaaaauaaucgacguuggcucuagaauuuucucaccuggggaaguggagaagaccggagauaguaaagcuaaggaaaggcgggagaaacgcggcacacgacguguaaucagaaggcgggaauuucgcuuagacagagugaggaaccugcuauaugagaaggguuaccucaaggggaauauuacuagcaacaucgucuccgugaaaaaugaggaacugacgauaaucuucaacgauaugguuaauaacuauuacaagucuaaagacaccaauccauauaagcugaaaguggaggcacuggaucggaaguugacaaacgacgaacucucgauuauccugguccacuacgccaagaaacgcggauacaagucaaaucgagaggagagcagugauaacgacaauggcaaagugaaggaagcgauuaaagagaacacuaaccugauggaagagaagaaauauagaaccaucuccgaaauguacauaaagaaugagaaguuuaaaaacaagauuaaaaauggcccggaugacuauaagcucucuguaacaaacgagauguacuuagaagagaucaauaaaguucuggauagccagauuggguucggacuuaucgacgacaacuuuaagaaugaauauuuggagaucuacaacuccaggcggcauuauucagaaggucccggcuacuacuaugcuaaggaugccaaugggaacaaagugaagguccguaguccuuacggaggcgaccugauuaaaaagaugaccggugugugcagcuucgauaaaaaggcacgcgccccaaaguaugcuuuuucuuccgagcuauucgugucaauaagcaaacucgucaaucugagauacaagaucgacgaugacaguuauaaacaacuuacuaaggagcagauuaacgaacugaucgaugaggcuaaaaauaagaacaagguuacauacaaaucuuugauaaagauucucgggaucaaaaauaucaaggugaaagaccugaacuuauccaagagcgaauauauuaaaguaaucgaugagcugaagaagaaacucaacauuucgaaggaagagaaaauagacaucuacucucuugaugaggaaaauaagaaaauuuacgacgacaucuauaacgagaagcuguuuuccaagaccuugaucgaguucaaaggauacaaucuacugaagaaagccauuacgcucucauauaacaguggcacuuggaaugaugugaaggacaacauagaauuucuggaugagcuugcucuguacuguaccgacuauaaagucaauaacgaaauccaggagcacauucauaauagcuugaucauugauuccagguucgacgauucuaacuuuguggaaaaucuccccaacuucaaggaccaccugauguuaagcacagauaucauacggaagcugaucccuauuaugcuagagggcaucacuuacgacaaagccauggauaagauuggguauaaucauucaaaccucuacaaagacaccaucaaggaagaucugcuuguuccaguguacgucaguaaaaauauaacaaaccagcgagugauucgcuccuugacccaagcgagaaagguaaucaacgcaauuaucaagaaauauggaagccccaagauaaucaauauugagacggccagggagcuggcuaaaacucagaaggaacggcgcaucauugagaaaaaccagcaggacaagcaauacgaaaaugagagaaucaaaaagcaccucguugaacuggagcuuuucucugacgagucaaagauaacagguaacgaucuguugaaauauaagcucuggcaggaacagaaagaguuuugcggcuacaguaugaagaaaauuaagcuggaagacuuauucagcaauaacaucgugcagaucgaucacauucugccuuauuccaggaccuacaaugacaacuaucuaaauaagacucucgucuacacaaaauacaaccaagauaaggggaauaaaaccccauaugagugguuuggaaagacggacaaauggcaggaauacgaggccuucaucaacucucugucgauuagccagaauaagaaggauaacuaucuuuugaaaaaucuggaccaagaugcagagcgugaaaugcgggagcagaaccucaacgacaccaaguacauaucccgagaacuguuaucacugaucaaagcauaucuuaauguggaugaggucaacgccuuuccgggcgcgauuacagccaaguugagagcaaggugggguuucaaucgccucacucauaguuacaucucuaaaaccuauauuaugcccgaggacaugaagaaggggaucaacaaagaucgggacaaucaccuucaucacgcuauggacgcccuagugauagcuagcaucacaaagucccugcagcagaaaauuacucucuacgaaaaguuuucaagauacguugauggcaucaccaaaaacgagcugggaaagauuagcacaggcaauaucaacgacgaucuuuauaauuacuaugacgaagagaccggggaaauaaaggaguuggagcugaggcaauacauuaaaaaccagguggcccagaauaacaucuauuucucuaagcacaauguauccaaauuaaucuuuccuacuccauacaacaauuucgucgaagaggcaaagcuccgcguguaugaacgagaucuggagguucuuaaauggaaccugaagaauuugggaacguacacaaguagcgaacucaaccggauucaugugcugauacccucugucgccaaaaacaagaucuccggucgucuacacgaggagaccuacuauggccugaaggaaguggggauuggagaggacaaaguaacuuacaagacccucaaaacaccuaucucaaaggugaaaaagaaggaucuggacaauauuccagauuguaaaggcgguaguaaggacaucuauaacgcucuuguuaaaugguuugggaauugcgaaaccggcgaggaagcguugaagaugcaugauggaaaauaccccgucaacccgaaugacaaggagcagaaggagauaagaaaaaucaagguguauacuaaauacaacgcaacaggccacguggucaauaacgggaauguugaaaagggagguauuuauaggaucgacguguucaaaagcaagaacaaggaggauaauaaacuguacuuuacgucguacgacauuuucgaaaucgagcaaauaaaggccuaugagaaaggcaagaacauuaauuucuccaucaaauuagaauacgggcagggaaagaacaauaaaauccuccuguauaaggaugugaagaacgaguacgaccuuauuaugucuaucuauaaaaacgaucugauacgcauuaagaccaaaacuggcaauaagagcacagcuuacguagucgguuuuucagggggcaaacuagaaaucaagaguaccauuggagacggcuaugauaucauagggaacaauaacauuuucgacaaguccauggagcgguacagagugacaucuagcacuaucguuaaaaucgauaagcucuccauuucaauccugggagaagugagcggcuuguga

SEQ ID NO: 2887 - RNA, 3657 nt, Artificial Sequence
  Cas9 variant
augaacaagagaauccugggccucgacaccgggacaaauagccuuggaugggccguggucgauugggacgagcacgcucaguccuacgaacugauuaaauauggugauguuauauuccaagagggcgugaagaucgaaaaagggauugagucuucaaaggcagccgaaaggaguggauacaaagcgauccggaagcaguauuuucgccgacguuugagaaagauucagguauuaaaagugcuggucaaguaccaucuaugccccuaucucagcgacgaugaccugaggcaguggcaccuucaaaaacaguacccuaaguccgaugagcugauguuguggcagcggacuucugacgaggaaggcaaaaacccauauuacgaucgccauagaugucuccacgagaagcuggaccugacgguggaagcugauagguacacccucggucgggccuuauaucaucugacacagcgccgaggguuccuuucgaauagauuggacacuucagcagauaacaaggaggacggaguugugaaaagcggcaucagucaacuguccaccgagauggaagaggccggcugcgaauaccuaggggacuauuuuuacaagcucuaucacgagcagggaaauaaagucaggauacggcagcguuacacagaucgcaagaaacacuaucagcaugaguucgacgcuaucugugaaaagcaagagcugucuagcgaacuuauugaggaucugcagagagcaaucuuuuuccaguugccgcucaaaucccaaaggcacggugugggccggugcaccuuugaacgagggaagccccgcugugccgacucacauccugauuacgaggaguucagaaugcugugcuuuguaaacaauauucagguuaagggaccacacgacuuagaacugaggccccucacuuacgaggaacgggagaaaaucgaacaccuuuucuuucgcaagaguaaaccuaacuucgauuuugaggacauagcuaaggaacuggccggcaaaaagaauuaugcguggauucaugauaaggaggagagagcauacaaauucaacuauaggaugacacagggugugccagggugucccaccacggcccagcuaaagagcaucuucggagacgauuggaaaacuggcauugcugaaaccuacacauugauccaaaagaaaaauggcucuaagucccugcaggagauggucgacgacguguggaacgugcucuauucauuuagcagugucgaaaagcugaaagaguucgcccaccauaaacuucagcuggaugaggaaaaugcagagaaauuugcuaagaucaaauugucucacuccuucgccgcgcucagccugaaggccauucguaaguuuuuaccuuuccugcggaaagggauguacuauacucaugcaucguuuuucgcuaacauaccaaccaucguuggaaaggaaauuuggaauaacgagcagucucgaaaauacaucauggaaaacgugggugagcuaguauuuaauuaccaaccgaagcacagagacgugcagggcacaauagagaugcucauuaaagauuuccuggccaacaauuuugaacuucccgcuggggccaccgacaaguuguaucacccuuccaugaucgagacguacccacaugcacugaggaacgaguucggaauccuccagcugggcucaccccgcacuaaugccauucggaacccuauggcuaugagaagucuucacguccugaggcgcgugguuaaucaguugcucaaagaaagcaucauugaugaaaacacagaggugcaugucgaguaugcgcgagaacugaaugacgcaaacaagcggcgugccauagcugauagacaaaaggagcaggacaaacagcacaagaaauacggugaugaaaucaggaaguuauauaaagaggaaaccgggaaggacauugagccaacucagacagaugugcugaaguuucaacuaugggaggaacagaaucacuacugccucuauaccggcgagcagaucggaaucacggacuucauuggcuccaaccccaaauucgauauagaacauaccaucccgcaaucuguagggggagacagcacacagaugaaucugacucuuugugacaaccgcuuuaaucgggagguuaagaaagccaaguugccuaccgagcuggcaaaccacgaagagauucucacaagaaucgaacccuggaaaaacaaguacgagcagcuggugaaggaaagggauaaacagcgaacuuucgccgguauggacaaggcugucaaagauauucgcauccaaaagcggcauaaauuacagauggagauagacuacuggagaggcaaguaugagagguuuaccaugacagaagugccagagggguucucacgucgccagggaaccggcaucggucugauuagucgguacgccgggcuuuauuugaagucccucuuucaccaggcagauagcagaaauaaaucuaacgucuacgugguuaagggcguggcgacugcugaguucaggaaaauguggggacugcaaucagaauaugaaaagaaaugccgagacaaucauagucaccacuguauggaugccaucacgauugcaugcaucggcaagcgggaguacgaccuaauggccgaguauuaccauauggaagagacauuucgccaggggagaggaagcaaaccuaaguucuccaagcccugggcuaccuuuacugaagauguacugaacauauacaaaaaucuccuggucgugcacgacaccccaaacaauaugcccaagcauacaaagaaguauguucagaccucuaaagguaaggugcuugcccagggcgauacugcaagggggucguugcaccuggacacauacuauggagcuauugagcgggauggcgaaauccgauacgucgugagacgcccuuuaagcuccuucacgaacccaaaggagcucgagaauauuguagacgaaaccgugaaaaggacuaucaaggaggccauagcggacaaaaacuuuaagcaagccaucgcugaaccgauuuauaugaaugaggauaaagguauccugauuaagaagguucguugcuucgcaaacucagucaaacagcccaucaauauacggcagcauagagaccuuaguaagaaagaguacaagcaacaguaucacgugaugaacgaaaauaacuaccuguuggccauuuacgaggggcucgugaaaaacaaggucguuagggaauuugagaucgugucuuauaucgaagcugccaaguacuauaaacgcagccaggaucgaaauauuuucuccucaaucgugccuacacacagcaccaaguacggccugccacuaaaaacaaagcugcucaugggacagcaaguacugauguucgaggagaaccccgacgaaauucaggucgauaauacuaaagaccuugugaagagauuguauaagguugugggcauagagaaagaugggcggaucaaguuuaaacaucaccaggaagcaaggaaggagggacugaccauuuacucuacgccuuauaaaaacaaugacgauuacgucccaaucuuccgccaguccauuaagaacaucaauauauuaguggacggcaucgauuuuaacauugacauccucgguaaaguuacccugaaggaauga

SEQ ID NO: 2888 - RNA, 3657 nt, Artificial Sequence
  Cas9 variant
augaacaagagaauccugggccucgacaccgggacaaauagccuuggaugggccguggucgauugggacgagcacgcucaguccuacgaacugauuaaauauggugauguuauauuccaagagggcgugaagaucgaaaaagggauugagucuucaaaggcagccgaaaggaguggauacaaagcgauccggaagcaguauuuucgccgacguuugagaaagauucagguauuaaaagugcuggucaaguaccaucuaugccccuaucucagcgacgaugaccugaggcaguggcaccuucaaaaacaguacccuaaguccgaugagcugauguuguggcagcggacuucugacgaggaaggcaaaaacccauauuacgaucgccauagaugucuccacgagaagcuggaccugacgguggaagcugauagguacacccucggucgggccuuauaucaucugacacagcgccgaggguuccuuucgaauagauuggacacuucagcagauaacaaggaggacggaguugugaaaagcggcaucagucaacuguccaccgagauggaagaggccggcugcgaauaccuaggggacuauuuuuacaagcucuaugaugcucagggaaauaaagucaggauacggcagcguuacacagaccgcaacaagcacuaucagcacgaguucgaugcaaucugugaaaaacaagagcugucuagcgagcuuauugaagaccugcagagagccaucuuuuuccaguugccgcucaagucccaaaggcauggugugggccggugcaccuuugagcgagggaaaccccgcugugcugauucacacccugacuacgaagaguucagaaugcugugcuuuguaaauaacauucagguuaagggaccacaugauuuagaacugaggccccucacuuacgaggagcgggaaaagaucgagccucuuuucuuucgcaaaaguaagccaaauuucgacuuugaagauauagccaaagcgcuggcaggcaagaaaaacuaugccuggauucacgacaaggaggaaagagcuuacaaguucaauuauaggaugacacagggugugcccggguguccuaccaucgcccaguugaaaagcauuuucggagaugacuggaagacgggcaucgcagagacuuacacccuaauccaaaagaagaacggcucuaaaucccugcaggagauggucgacgauguguggaaugugcucuauucauuuagcagugucgaaaagcugaaggaguucgcucaccauaaacuucagcuggacgaagagucugccgagaaguuugcgaaaauuaaguugucccacagcuucgccgcacucucgcugaaagcuauacguaaguuuuuaccauuccugcggaaggggauguacuauacacaugccuccuuuuucgcuaacaucccgacuauuguuggaaaagaaaucuggaauaaggagcagaaccgaaaauacauaauggaaaacgugggugagcuaguauuuaauuaccaacccaagcacagagaagugcagggcaccauugagaugcucaucaaagauuuccuggccaacaauuuugagcuuccugcaggggccacagacaaguuguaucauccaucuaugaucgaaaccuaccccaacgcucagaggaaugaguucgggauucugcagcucggcucaccucgcacgaacgcgauccggaauccaauggcaaugagaagucugcacauucuuaggcgcgucgugaaccaacuguugaaagaaagcauaaucgaugagaauacugaaguucacguggaguaugcccgagagcucaacgacgcuaauaagcggcgugccauugcagauagacagaaggaacaggacaaacagcauaagaaauacggugaugagaucaggaagcuguauaaagaagagacagggaaggacaucgaacccacccaaacugaugucuuaaaguuucagcugugggaggagcagaaccaccauugccuauacacaggcgaacaaauuggaauaaccgacuucaucggcuccaauccgaaauucgauauugagcacacgaucccucagucugugggaggagacagcacccagaugaaccucacacugugugacaaucgcuuuaaccgggaaguaaagaaagccaaacuucccacugaguuggcuaaccacgaggaaauucugaccagaaucgagccauggaaaaauaaguaugaacagcucguuaaggagagggauaaacaacgaacauucgccgguauggacaaggcagugaaagauauacgcauccagaagcggcauaaacugcagauggaaauugacuacuggagaggcaaguacgagagguuuacuaugaccgaggucccugaaggguucucacgucgccagggaacaggcaucgguuuaauuagucgguaugcggggcuguaccuuaaguccuuguuucaccaagcugauagcagaaacaaaucuaauguguaugucgugaagggcguugccaccgcagaguucaggaaaauguggggacuccagucagaauacgagaagaaaugccgagacaaccauagucaccauuguauggaugccaucacuauagcuugcauuggcaagcgggaauaugaccugauggccgaguacuaucgcauggaggaaacguuuaaacaggggagaggaagcaagcccaaguucuccaaaccaugggcaacauuuaccgaggaugugcuaaauaucuacaagaaccugcucguaguccacgacacucccaauaacaugccuaaacacaccaagaaauacgugcagacaucuauugguaagguucuggcucaaggcgauaccgccagggggucgcuucauuuggacacuuauuacggagcgaucgaacgggauggcgagauacgauauguggucagacgcccacugagcuccuucacaaagccggaagaguuagagaauaucguggacgaaacgguaaaaaggaccauuaaggaggccaucgcugacaaaaacuuuaagcaggcaauugccgaacccaucuacaugaaugaggagaaagguauacucauuaagaaggugcguugcuucgcuaaaucaguuaagcagccuaucaacauccggcaacacagagaucugaguaaaaaggaauauaaacagcaguaccaugucaugaaugagaacaauuaucuucuggccauuuacgaaggguuggugaagaacaagguggucagggaguuugaaaucguuucuuacauugaggcagcgaaauauuacaagcgcagccaggaccgaaacauauucuccucaaucgugccaacucacagcacaaaauauggccucccccugaagaccaaacuacugaugggacaacucgugcugauguucgaggaaaauccugaugagauucagguagacaacacaaaggaucuugucaagagauuguacaaagugguuggcaucgaaaaggacgggcggauuaaauuuaaguaucaucaggaggccaggaaagaaggacugccaaucuucucuacucccuacaagaauaacgaugacuaugcuccgauauuucgccaguccaucaauaacauuaauaucuuaguggauggcauugacuucaccaucgauauacucgguaaagucacgcugaaggaguga

SEQ ID NO: 2889 - RNA, 3657 nt, Artificial Sequence
  Cas9 variant
augaacaagagaauccugggccucgacaccgggacaaauagccuuggaugggccguggucgauugggacgagcacgcucaguccuacgaguucauuaaauauggugauguuauauuucaagagggcgugaagaucgaaaaagggauugagucuucaaaggcagccgaaaggaguggauacaaagcgauccggaagcaguauuuccgccgacgucugagaaagauucagguauugaaaguguuagucaaguaccaucugugccccuaucuaagcgacgaugaccucaggcaguggcaucugcaaaaacaguacccuaaguccgaugagcuuaugcuguggcagcggacuucugacaaaaagggcaagaacccauauuacgaucgccacagauguuugcacgagaaacucgaccugacgguggaagcugauagguacacccugggucgggcccucuaucauuuaacacagcgccgaggguuucugucgaauagacuugacacuucagcagauaacaaggaggacggaguugugaaaagcggcaucagucaauuguccaccgaaauggaggaggccggcugcgaauaccugggggacuauuucuacaagcuauaugaugagcagggaaauaaagucaggauacggcagcguuacacagaccgcaacaagcacuaucagcacgaauuugaugcuaucugugagaaacaagaacucucuagcgagcugauugaggaccuucagagagcaaucuucuuucagcugccguugaagucccaaaggcauggugugggccggugcaccuucgaacgagggaagccccgcugugccgauucacacccugacuacgaggaauuuagaaugcucugcuucguaaauaacauucagguuaaaggaccacaugaucuggaguuaaggccccugacuuacgaagaacgggagaagaucgaaccucucuuuuuccgcaaaaguaagccaaauuuugacuucgaggauauagcuaaagcccuugcgggcaagaagaacuaugcauggauucacgacaaagaagagagagccuacaaguucaauuauaggaugacacagggugugcccggguguccuaccacggcucagcugaaaagcaucuuuggagaugacuggaagacuggcauugccgaaaccuacacauugauccaaaagaagaacggcucuaagucccuacaggagauggaggacgaugucuggaaugugcuguauucauucagcaguguggaaaaacucaaggaguuugcacaccauaaacugcagcuugacgaagagucugcugagaaguucgccaaaaucaagcugucccacagcuuugcggccuugucgcucaaggcaauucguaaauuccugccauuuuuacggaaggggauguacuauacucaugcuucuuucuuugccaacauaccgaccaucgucggaaaagaaauuuggaauaacgagcagaaccgaaaguacaucauggaaaauguuggugagcugguguucaacuaccaacccaaacacagagaaguacagggcacaauagagaugcuaauuaaggauuuucucgcuaauaacuucgagcugccugccggggcaaccgacaaacuuuaucauccauccaugaucgaaacguacccccacgcccagaggaaugaguuuggaaucuugcagcugggcucaccucgcacuaacgcuauucggaauccaauggcgaugagaagucuccacauccugaggcgcguggucaaccaacuucugaaggaaagcauuauagaugagaauacagaagugcauguugaguaugcacgagaguugaacgacgccaauaagcggcgugcuaucgccgguuggcagaaagaacaggauaagcagcacaaaaaguacguggacgagauuagaaaacucuauaaggaagagaccgggaaggauaucgaacccacucaaacagacguccugaaauuccaguuaugggaggagcaggaucaucacugccuguacaccggcgaacaaaucggaauuacggacuucauaggcuccaacccgaaguuugauaucgagcacaccauuccucagucuguagggggagacagcacacagaugaaucuaacucucugugacaacagguucaaucgcgaaaucaaaaaggcaaaacugcccgcccagcuuucaaaccaugaggagauuuuggcucggaucgaaccauggaagaacaaguaugagcagaaaauaaaggaaagagauaaacaaaggaccuuugccgguauggacaaggcagugaaagaucugcgaauccagaagcgccacaagcuccagauggacauugauuacuggcggggcaaauacgagagauucacaaugacugaaguuccugagggguuuaguaggcgucaaggaaccggcaucggucugauuucccgcuaugcgggguuauaccugaaaagccuuuuccaucaggcugacucucggaauaaaucaaacguguaugucgugaagggcgucgccacagcagaguuuagaaaaauguggggauugcagagugaauacgagaagaaaugcagggauaaucacagccaucacuguauggacgccaucaccauagcuugcauuggcaagcgagaauaugaucucauggccgaguacuaucggauggaagagacuuuccgccaggggagaggauccaagcccaaauuuucuaagccaugggcaacguucacagaggacgugcugaacaucuacaaaaaucuacugguugugcacgauacccccaacaauaugccuaagcauacuaaaaaguacguacaaaccucgaaggguaaaguccucgcucagggcgacacagccagggggagccugcaccuugauaccuauuacggagcgauugaacgggacggcgagauccgauaugugguuagacgcccauuguccucauuuacuaagccgaaagaacuggagaacauaguggacgaaacagucaagaggacgaucaaagaggccauugcugauaagaauuucaagcaggcaaucgccgagcccauuuacaugaacgaagacaaagguaucuuaauaaagaaagugcguugcuuugcuaagaguguaaaacaaccuauuaauauccggcagcauagagaucucucuaagaaggaguauaaacagcaguaccacgugguuaacgaaaauaacuauaugcuggucaucuacgaggggcuugugaagaauaaaguggucagggaguucgaaauuguuagcuacaucgaggccgcaaaguauuacaaacgcucccaagaccgaaacauuuucucaagcauagugccaacccauucugcgaaguauggccugcccuugaagacuaaacuccugaugggacagcuagugcugauguuugaagagaacccugaugaaauccagguagacaauacaaaggaucucgucaaaagacuguacaaggugguuggcauuaaaaaggacgggcgggugaaauucaaguuucaccaggaggccaggaaggauggacuuuugaucuucuccaccccauauaaaaacaauaacggcuacguccccauuuuucgccacaguaagaaaaauaucaacauacugguggacgguaaggauuucacaaucgacauuuuagggaaaguuacucucaaggaguga

SEQ ID NO: 2890 - RNA, 3660 nt, Artificial Sequence
  Cas9 variant
augaaggaggaagugagaggcaaaaacaggagccagaccugggccauccuggcuaaguucuuugucugguccgagaaagaaucuguuuggaaugagaaggaagcacggacagaggagcgcgugaaagaauacaagcucguagggcuuaagcgagacacuaaaggaaacgagcugaaguuggaaaauuaucguuggagagugcaagccuuaucagagcagcugaaccccgagauugucgcgauagugcuacaggaaaucaauggucagauuagugcuagcuccggcuaccucggggccaucucugauaggucgaaacaacuguauuucaaccggcagacgguuggacaguaccuuaugucagagcuggaaaaggacccuaaugugagcuugcgcaacagagucuuuuauaggcaggauuaccucgacgaguucgaucggauuugggaaaaacaagcagaguuucacgaggaacugaccguggagcugaagaaggaaauccgcgacauaaucauuuucuaucagcgaagacucaaaagucagaagggcuuaaucuccuuuugcgaguucgaaaagagggagguaguuguggaggaagauggucggaagaaaaauaagacagucgggugucgugugauuccacgcucucauccgcuguuucaggaguucaaaaucuggcaaacucuuaacgacauagaaguguuugccugggauaagcagagcaagcgcaaaaaggcugacaaauccucaauuuuguucgauaauagugaggacgcacugcuagucgaaggaaagagguuucucuaccaggaggagaaagaacugcuugccaaggagcuguucguuaaggaaagcaugaaaaaggcugagguguugaaacuccuguucgagaacuaccaagaauuagaucugaauuuuaagcagaucgacggcaaccacaccggcuucgcccucuuuucugcguauuccaaaaugauugagaaguacggguaugaacccguagacuucaagcggucagcagaugagaucaucgaaaaacuugagacaauuuuuaccaaucugggauggaacacugaguugcuaagcauagaccugaguaaggaagauaaagagcucgaacgacagucuuacuuccgccuguggcaucuucuguauuccuuugagggugacaacacaccuaccggcaaugggaaguugcucgagaaaaucaugcagcugugcgauguggaaaaggaguacgccgucgaauuagcuaacgugagcuuccaagaggacuauggaucgcugucugccaaggcaauuaaaaagauccuaccauaccucaaagaaggcaaucaguacgauguugcuugugacuaugccgguuacagacacuccaggucaagucugacgaaggaugagauagaaaacaaaauucuuaaggacaaauuggagauccugcccaagaauagccuccggaacccuguggucgagaagauccugaaucagauggugaaccuuauuaauacucugaucgauaccuaugggaaaccagacgaaauucgcguagaguuggcgagagaacucaagaaaaacgccaaggagagggaggaacugacaaaauccauagcacguaauacucgggagcaugacgaaauccgacaguuacugagaaccgaguuuggaaugaugaacguuucuaggaaugauauuauccgcuacaagcuauaugaggaacucaaggacaacggcuacaaaacacuguauagcaaugaguacaucccccgggaaaagauuuucucaaaagagauagauaucgaacacgugauuccucaagcuagacuuuuugacgauaguuuguccaacaagacccuggaguacagggccaucaacauugaaaaaggcaauaagacggcuuaugacuucgucaaggagaaauacgggaacgauggacucgagaaguuucugaaucgcugcgaaacuuuauucaaagacaagcgaacaaaacugcggaaacuuaagauggaggaaaaagauaucccagaggguuucauagaccgugauuugagaaacacccaguauaucagcaagaaagccuuugcaaugcucaaugaaauuucuaggcgcguggucgccacuacaggcucaaucaccgacaagcugcgggaggauuggcagcuaguggaccugaugaaagagcucaaccugccgaaguacgaaaaacuugggaugguugagauguucgaagacaaggauggaagaaagauuaaaaagaucacggacuggaccaaaaggaaugaucaccgacaucacgcuguggacgcguugacaguagcauuuacuaaggaugucuucauacaguuuuauaacaauaaaaacgccgcuuggaugcccgccaguaaggagcaugcaaauauuaccggcaucaaggcccgcuacuucgagaacgguaaagcucuggccccuaugccauuagcacaauuucgggcggaagcuaagagacaccucgagaaucugcuugugagcauuaaagccaagaacaaaguuaucacauccaaugugaacaggacuaagaacaagaauggggaaaaccguaaacugcagcagacccccagaggccaguugcaccucgagacagucuauggaucucaucggcaauacgcaaccaagauagaaaaagugaaugccgcuuucgacguaacuaagaucgccacggugucgaaacuggcauacagaaacgcucuacugaagaggcucgaggccuuuggcaaugauccuaagaaagcguucacagggaagaacacccuggagaaaaauccacuuuauuuggacgaaaaccagacugagaugguucccgaaaagguccagaccguggaguuugaaacaguguacaccauucgaaaaccgaucgauccuaaucugagcauugacaaggucguugaugugaagauccgguccguguuagagaaacgccucaaggaguauggaggugacgccaaaaaggcuuucguaaaccuggaugaaaaucccauauggcuuaacgaggcaaaaggcauuucaaucaagagagucaguaucagggggauuucuaaugcccaaagccugcacgagaaaaaggacaaggacggaaaccuaauccucggcaaagaaggucggaagauuccaguggauuuuguuaauacugggaacaaccaucacguggcuauauacaaaaagccuguccuggacaaagugggccagguuguguuggaugaagagggaaaucccaaguaugagcuggacgaaguagucguguccuucuucgaugccgugacacgagcaaacuuaggccagccaaucauugacaaggauuacagacgcucagagggguggcaguuucucuucagcaugaaacaaaaugaauauuuugucuuccccaacgacaagacgggauuuaauccuaaagagguugaucugcuuaacccagagaauuacgcgcugaucucuccgaacuuguucagggugcagaaguuugccuacaaaaauuauguauuccgucaucaccucgaaaccacuauuaaggacacauccaguacccugaaggguaucacauggacugauuuucggagcucuaaaggccuagacaagauagugaaagucagaguggaccacaucgggcagauuguuuccaucggagaguacuga

SEQ ID NO: 2891 - RNA, 3663 nt, Artificial Sequence
  Cas9 variant
augaagagaauccugggccucgaccuugggagcgccuccauuggaugggcucugauagaggaagaugagaaagguaucaggauuaucgcauugggcucucggauuauccccuacaacgggaccgaaggacaggacuucgccaagggcgcgggugagucacgcaauaguuuacgaacacaagcucguacuacgagaaaaggguaugauagguaccagcugcggcgcaaguaucuaauaaacgugcucgagaaaaaucugaugaugccuagcgaagaccuuagaaagaugccaaagaugaaccuguggcaguugagguccaaagccgucaccgaguacaucucucggcaggaacucggacgccugcugcucugguuaaaucaaaagcgaggcuauaaaucgucaagaagcgaugcaaaccuggacaagaaagauacagacuacguuaaggaggugaagaguagguuugauaaaauuaaggagaaaaaucagacuaucggccaguauuucuacgaaucccuucagugcgacgaguacuuucggguaaaggaaaacguguucccgcgugaggccuauauugcugaauuugaugcaaucuguucucgccaaaaagaccacuuggggcugagcgaggaacuaauagccgagauuagaaaugagaucauuuacuaucagaggccccucaagucccagaaaggacuggucucaguguacgauuucgaagguaaguggaugaaccagaauggcaaggagcuuuuuaucgggccuaaaguugcucauaagaguagcccacuguuccaauuggccaaaaucugggaaucugugaacaauauuaagcucuccaccaaauauggagacacaauagagcugaccuuagaagagaagaagcagcuggucgaguuucucgacaacaaugaaaaacuuacuacagcggcacuguucaagaucuugcggaaagauaagaaagaguacauucuacccaagcagcuggaaaagggccuccaagguaacaucaccaaaugcaagauagccgacauucuggggucaaaauauaaccagcuucugcaguugaaucucgagaagcaggaagugggaacgccuuguuaccuguacacuaaaagcaccggcgagguauuaggcgagaagccacugcaauauaucgauaagaguguugaaaaagagcuauuuuaccagcucuggcacacaaucuauucuauuuccgacgaagaugagugcuguaaggcucugcagaaacgauucgacaucgaugccgagacugcagggcgccuugcuaagauugacuuuagcaaauacggauucgguaacaagucggccaaagcgauaagaaagaucuugcccuaucugauggaaggcgauaaguacucugacgccaugugcuaugcaggguacaaucauuccaacucacucaccaaagaggaaaaucacgagaggaagcugaacgauaaacuuaagcuguugaccaaaaauagucuccggcagccuauuguggaaaagaucaugaaccaaaugauccagcuggucaauaccauuauagacaaguacggaaaaccagacgagauccgcuuagagcuggcuagagaacuaaagcagagcaaagaggaaaggaacgaugccgacaaggcuauguccaaacgucagcgggagaauaaggaagccgagaagaaacucgaggaacauggcauucgagcaacgcacaacaauauccugaaguauagacuuuucgaggaaaugggugagaaaaagcacgaagccauuuguaucuacugcgggaacccgauaucuuuuagcgcugcgaugaauggcgaugagguggacguggagcauaucauucccaggucaaaauuguucgaugacagucaauccaacaagacucuggcacaccgcaaguguaacgccaauaaaaacgauaugacagcuuaugacuuuaugaagaccaaaagcaagcaggauuucgacaaauacgucgaacggguuaaucagcucuaugccgauagaaucauuucuaggucaaaguacaacaaacuguuaaugagugaggacgauaucccuagcaauuuuauagaccgccagcugcgagaaucccaauauauugcaacuaaggcccgggagauccuucagacaauuugcuacaacguguggucuaccucgggaacgguaaccgcugaguugcgucaucucuggggcugggacgauaucacaaugaaucugcagaugccaaaguacaaagaacuagggcugacugagaugguggaauggaccagcgaccacggaaagaacguccacuccaaagaggugauaaaggguuggacaaaaagagaugaccauaggcaccaugccaucgaugcacucacuauugcguguaccaagcaaggcuucauccagcgcuuuaauacacugucaaguucuaagacccgggacgauaugcagaaagaacuugagaagugcagcauucaguucagagagaaaagguccuugcuggaaaaguauaucauaucacaacgacccauuagcguuucugacguggcugaggccgucucccgcaucuuaaucaguuuuaaagcagggaagaagguggccacuauuggaaaacggaagguaaaaggcaagguugugcagcaggguaucgucgugccuagaggggcucucagcgaaggcucugucuacggaaaaauuaggacgauagugcguaagaugccaguuaaguaucuguucgagaaccccgaucuuaucuuuaaaccguacauuaaggcccuggugaaagaacgcuuggcagaguucgacaaugauaacaagcaggcucucgccucccugaaaaagaauccuguauaucuagacaaggagaaaacaaagcugcucgaauacggcacaugcuuuaaagaugaguaugucaagaaauacgacgugaaccccaauuucacuaagaucgcggacguuauugaugggaaagugaagcaaauccuggaagaccggcuuucaaaguucggagguaaaccaaaggaggccuuuaaagaugucgugaaggacggcaaaaccuugaagugguacgaagaugaggggcuggagagaccuauaaggaguguacgauguuuaacaggacucagcgcugugguucccgucaagaaagacgaaaacggcauggauaucgguuucgugaagccagggaacaaucaccauguggcaauuuaugucggcgccgacggaaaaggccaggagcacguuugcaccuuuuggaacgcuguggaacggaagaaauacgggcugcccaucauuaucaaggaugccaaugaggugugggacaagauaacuauggcaggagaugacguauauccucagucguuccuuucccugcuaccaaaaccggacuggacacucaagcugucuaugcagcaaaacgagauguuuauuuugggcauggaagaggaugaagucaaauucgcgaucgagagcaaggacuacaaacuguuaucagaucaccucuaucgcgugcagaagcugaguuccucugacuacaauuuuauccaucaccuugaaacggauguucagaagaaaaccaugacuuauagagugaggagccuguccgguuuguucgcccuccggcccuuuaagguccgaauugacugucuggggaacauaaucccuucauga

SEQ ID NO: 2892 - RNA, 3669 nt, Artificial Sequence
  Cas9 variant
augaagaaaagaauccugggccucgacagcgggaccaacucccuuggaugggccguggucgauagggacgagaauaaccaguacucucugauuaaguauggugauuugauauucgaagagggcguuaaaaucgaaaaggggguggagucaaguaaagcugcagaacggacaagccaccgcgccuuacgaaagcuguacuuucguagaaggcuacggaagauugagguacucaaagugcuggucaaguauaaucuuugcccccaaguguccgaggaagaacugcauuuguggcacacucgcaaacucuacccucagaacaaggaccugcugcaguggcagagaacggaugaaaaagcgggaaagaauccauauaucuacagguaucggugucuccaugaggaguuagacaugucuguuucggcuaaccgcaugaccgugggccgagccauguaccaccuggcacaaagaagggguuuccuuucaaaucgguuggauaacgaagaggacgaaaaucagauuggggccgucaagugcggaaucagcaaccugacagaggaaauacagaguuccggcuguaaauaccuaggcgaguauuuuuacaagcucuauaaugagcaugggaacacugugcgucugcgcaccagauacacaucuagggaguuccacuauaaaaaggaguuuuacgcuaucugcgaaaaacagaaacuugauaaaaagcugauugaggaauuggcaagcgcccucuauuuccaacggccgcugaagucccagcgacacaccguaggacgcuguacuuuugagcccaauaaaccuagaugcgcugacucacauccagccuacgaggaguucaggauguuaaguuuuaucaacacaauuaagguucagggucccuacgauaccgaacugcgggugcucaauacggaggaacgcgacagcaucacuaaacuuuucuguagaaagucuaaaccuaacuuugauuucgaagacauagcgaaggagcuggcaggcaggaacaauuauugcuacauuggggacgucguggauaaggccuauaaauuuaacuaccguaugucccagggagugucaggcuguccaaccacaacuuauuugaucaaugucuucggucaagacuggcagaccgggauugcugagagcuaccaggccaucgauacaaagcuaggacaaaagaguguugacgcaaugaucgaugacguguggaacguacuguauucuuucuccagcaaggauaaacuccgggacuuuggccgaaagaagcugcagcuuggcgauaaagaagcugacaccuucgccaauauuaagcugacgcacaaauuugcgucguugucucucaaggccauaagaaaaaucaacauuuuccugaggaugggguuaguguacucccaugcagucacucuggcuaauauccccacaauagugggaaccgauauuuggcagcgcaagcggaacuuuauccuagccgagcuccugccucuuaucgaaaauuucaacccaaaggagacuaaauugcaggagacacuggacuuuugcguuaaggacuuccuccaaaauaacuuugaacugaaaaauggugcuguggauaaacuuuaccacccgucaaugauugaggccuaucccgacgcaggccugaacaguaaugggaucuugcagcucggaagcccuagaaccaacgccauuaggaacccaauggcuaugcgcucccugcacgaaauacgaaaagucaucaaucaguuacugaaggauaaaauuaucaaccaggacacggagauccauguggaauacgcgcgggagcuaaaugaugcaaacaagcguaaggccauuucuauauggcaaaagagccaggagaagcuccacaaaaaguauguagaagagaucaccaaucuguacaaagaagagacaggcaaggcuauuguucccacugacaccgauauccuuaaguucaaauugugggaggaacagaaccauauuugucuguauacaggucagcaaaucgggauagccgaguuucucggcgcaacuccuaaguacgacaucgaacacaccauuccacagucagugggaggcgauaguacagacaugaaucugaccuuaugcgauuccagauucaacagggagaucaaaaaggcccagcugcccacucagcuugggaaucaugcugacauuuugguccgcaucgccggauggaaaaacagcuaugaaaagcucucuaaggauauagaccggauuagaacgcacucagguauggcaaaagacaucaaggauaggcugauucaaaaacgacaccuacugaagcucgagcgcgacuacuggcggggcaaauacgaaagauuuacaaugaaugagaucccggagggguucaguaggcgucagggagugggcauaggucugaucagcaaguaugcggggcuuuacuugaagucccuguuccaugauaaaaacgaacgcaauaagggccacgucuuugugguuaaaggaaccacuaccgcugaguuccggaagauguggggcuuacagaacgaauaugagaaaaagucuagaaauaaccaugugcaccacugcauugacgccaucacaauugcauguaucgggaaacaugaguacgcccaaauggcucaguauuaccacgaugaagccgaguaucucuaccaucacggaauaaagccuauuuuucccaagccauggaaaaccuucacugaagaccugcuugaucuggagcauucguuguuuguaguccaccacagcccuaacaauauggcaaagcaggcuaggaaacgaaucaucacauccacgggucagcauugggcccaaggcgacucagcgcacgggagucuccauaacgauaccuacuauggagccauugaacgggacggcgagaucaaguacgugguucgcagagcugugucuagcuucgagcagauguccgaugucgacucaauuguggaugacguagugaaagaaacuguuaggaaggcacuggaggguaagaauuuuaaagaagccgucaacgcucccauauauaugaauaaggagaaaggggugcuaaucaagaaagugcggugcuacgccaagagcauuaagaaaccaaucgacauucgaacacacagagauucuuccaguaaggaauauaaacgcaaguuccaugucagcaacgacaucaauuaccugauagcaaucuaugagggcaccguuaaaggaaaggugaagagggauuuugagguggucaaaaacauugaagcggccaauuucuuuaagcguucucaggaccggagagauuaccccacaaucguaccugagaaauccauuaagcacggcuucccacucaaaacuacccugacgaacgggaccauggugauccuuuacgaagagaauaaggaagagauagacuuuacaaagaaagaggauauuuguaggcgcuuguauaagcugguuggaaugucaaguaugaucgugagcggcugcgaauacggugucuuaucgcuccgacaccaucaggaggcuagaccguccaaagacaucaagucuaaaaacggggccuucaagaauggagaagcacugcggcccgcuauuacuaugcuucacacccaauucaacgcccugguggagaauauagauuuuaacaucgacguuacaggcaacauugagcuaaucuga

SEQ ID NO: 2893 - RNA, 3669 nt, Artificial Sequence
  Cas9 variant
augaagaaaagaauccugggccucgacagcgggaccaacucccuuggaugggccguggucgauagggacgagaauaaccaguacucucugauuaaguauggugauuugauauucgaagagggcguuaaaaucgaaaaggggguggagucaaguaaagcugcagaacggacaagccaccgcgccuuacgaaagcuguacuuucguagaaggcuacggaagauugagguacucaaagugcuggucaaguauaaucuuugcccccaaguguccgaggaagaacugcauuuguggcacacucgcaaacucuacccucagaacaaggaccugcugcaguggcagagaacggaugaaaaagagggaaagaauccauauaucuacagguaucggugucuccaugaggaauuagacaugucuguuucggcgaaccgcaugaccgugggccgagcuauguaccaccuggcccaaagaagggguuuccuuucaaaucgguuggauaacgaggaagacgagaaucagauuggggcagucaagugcggaaucagcaaccugacagaagagauacagaguuccggcuguaaauaccuaggcgaguauuuuuacaagcucuauaaugaacaugggaacacugugcgucugcgcaccagauacacaucuagggaguuccacuauaaaaaggaauuuuacgccaucugcgagaaacagaaacuugauaaaaagcugauugaagaguuggcuagcgcacucuauuuccaacggccgcugaagucccagcgacacaccguaggacgcuguacuuuugagcccaauaaaccuagaugcgccgacucacauccagcuuacgaagaguucaggauguuaaguuuuaucaacacaauuaagguucagggucccuacgauaccgaacugcgggugcucaauacggaggaacgcgacagcaucacuaaacuuuucuguagaaagucuaaaccuaacuuugauuucgaggacauagccaaggagcuggcgggcaggaacaauuauugcuacauuggggacgucguggauaaggcauauaaauuuaacuaccguaugucccagggagugucaggcuguccaaccacaacuuauuugaucaaugucuucggucaagacuggcagaccgggauugccgaaagcuaccaggcuaucgauacaaagcuaggacaaaagaguguugacgccaugaucgaugacguguggaacguacuguauucuuucuccagcaaggauaaacuccgggacuuuggccgaaagaagcugcagcuuggcgauaaagaggcagacaccuucgcuaauauuaagcugacgcacaaauuugccucguugucucucaaggcgauaagaaaaaucaacauuuuccugaggaugggguuaguguacucccaugccgucacucuggcaaauauccccacaauagugggaaccgauauuuggcagcgcaagcggaacuuuauccuagcugaacuccugccucuuaucgagaauuucaacccaaaggagacuaaauugcaggaaacacuggacuuuugcguuaaggacuuccuccaaaauaacuuugagcugaaaaauggugccguggauaaacuuuaccacccgucaaugauugaggcuuaucccgacgccggccugaacaguaaugggaucuugcagcucggaagcccuagaaccaacgcaauuaggaacccaauggccaugcgcucccugcacgagauacgaaaagucaucaaucaguuacugaaggauaaaauuaucaaccaggacacggaaauccauguggaguacgcucgggagcuaaaugaugcgaacaagcguaaggcaauuucuauauggcaaaagagccaggaaaagcuccacaaaaaguauguagaggaaaucaccaaucuguacaaagaggaaacaggcaaggccauuguucccacugacaccgauauccuuaaguucaaauugugggaggagcagaaccauauuugucuguauacaggucagcaaaucgggauagcugaauuucucggcgccacuccuaaguacgacaucgagcacaccauuccacagucagugggaggcgauaguacagacaugaaucugaccuuaugcgauuccagauucaacagggaaaucaaaaaggcacagcugcccacucagcuugggaaucaugccgacauuuugguccgcaucgcuggauggaaaaacagcuaugagaagcucucuaaggauauagaccggauuagaacgcacucagguauggccaaagacaucaaggauaggcugauucaaaaacgacaccuacugaagcucgaacgcgacuacuggcggggcaaauacgagagauuuacaaugaaugagaucccggaaggguucaguaggcgucagggagugggcauaggucugaucagcaaguaugcagggcuuuacuugaagucccuguuccaugauaaaaacgagcgcaauaagggccacgucuuugugguuaaaggaaccacuaccgcggaguuccggaagauguggggcuuacagaacgaauaugagaaaaagucuagaaauaaccaugugcaccacugcauugacgcuaucacaauugccuguaucgggaaacaugaauacgcacaaauggcccaguauuaccacgaugaggcugaauaucucuaccaucacggaauaaagccuauuuuucccaagccauggaaaaccuucacugaggaccugcuugaucuggaacauucguuguuuguaguccaccacagcccuaacaauauggccaagcaggcaaggaaacgaaucaucacauccacgggucagcauugggcucaaggcgacucagcccacgggagucuccauaacgauaccuacuauggagcgauugagcgggacggcgagaucaaguacgugguucgcagagccgugucuagcuucgaacagauguccgaugucgacucaauuguggaugacguagugaaagagacuguuaggaaggcucuggaagguaagaauuuuaaagaggcagucaacgcccccauauauaugaauaaggaaaaaggggugcuaaucaagaaagugcggugcuacgcuaagagcauuaagaaaccaaucgacauucgaacacacagagauucuuccaguaaggaguauaaacgcaaguuccaugucagcaacgacaucaauuaccugauagccaucuaugagggcaccguuaaaggaaaggugaagagggauuuugaaguggucaaaaacauugaggcagcgaauuucuuuaagcguucucaggaccggagagauuaccccacaaucguaccugaaaaauccauuaagcacggcuucccacucaaaacuacccugacgaacgggaccauggugauccuuuacgaggaaaauaaggaggagauagacuuuacaaagaaagaagauauuuguaggcgcuuguauaagcugguuggaaugucaaguaugaucgugagcggcugcgaguacggugucuuaucgcuccgacaccaucaggaagccagaccguccaaagacaucaagucuaaaaacggggcuuucaagaauggagaggcccugcggcccgcaauuacuaugcuucacacccaauucaacgcucugguggagaauauagauuuuaacaucgacguuacaggcaacauugaacuaaucuga

SEQ ID NO: 2894 - RNA, 3678 nt, Artificial Sequence
  Cas9 variant
augagcaagagaauccugggcauugacguggggaccaacucccucggaugggccgucguugauaggacagacugcgauaauuacacucuugugaaacggggugacguaauauuccaggagggcgugaacaucgaaaaggggaauauugagaaaucucgcgcuucagaacgaacgggacaccguaguaccagaaagcauuauuuuaggcggcgcaugcugaaaaucaaggucuuggagauuuuaguggaacaccaacugugucccuaccuaagccaugaggagcuccaccaguggaugacaagaaagguuuauccuacuaacgaagauuucaggcuguggcuucggaccaaugacgcaaacgaucagaauccauaccaugaccgccacgugugccugcacgagcgauuggaucucagacugcaggaaaacagguaucggcugggccgugcccucuaccauuuagcgcaacgcagagguuuucuguccaauaggcuugagcagaacucuaaaacagacgagaccggggcugucaagucggauaucucacaguugaaugaagagaugaaaaaggccggaagccaguaucugggcgacuacuucuacuggcuauaucaagaauacggcaaccaggugacucuccggauacgauauacagaucgcaaacagcacuaccagaaggaguuugaagcaaucugucaaagacagcagcugagugacgaccuuguagauaagcugaggcgggccauuuauuuccaacgcuccuugaaaucucagagagcugggguuggaaagugcaccuuugagccggacaaacccaggugugcacucagccauccucguuacgaggaguuccggaugcuguccuuuuuaaauaacgugaaggucaaagguccaucagaugacagucugcgaccccucagcccuucugagaaggaaaagaucaagccacuuuuccugagaaaguccaaagccaauuuugauuucgaggacauugcuaaggccaucgcgggcaaagggaaguaugcaugcauaagggauaaagaaggagcccagaagcccuaccaguuuaacuacgcuuugucacaaggcgugagcgguuguccugugacggccaagcuaauugcagucuucggggagaguugggagcgcaaccugguuaaugcuuaucggucuagaaacgacaugaggaaauccgaugaagagaucgugaaugaaguauggaacgugcucuacagcuucucgucuaaggagaaacugcgcgccuggggaauggaaaaacuuggccuggacgaggcgugcgccggcgaguuugcagauauuacuuugccaaccgcuuucgccgcucucucccugaaagccgucaauaagaucuuaccguuucugcgacagggguucaucuauucacacgcagugaugcuagccaacauucccuacauaaucggaauggaccgguggaaugaaccucgucagagacaguuuauuauggacaaccuccaagagcugcuugauaauuucacagcuagugacaaggcguugcagcagacucuggauuuuuguaucaaagacuuccuccugaacaauuaugaacuugcaccagguaaggccgauaggcuguaccaccccagcaugauagagaccuauccugacgcuaaagccgauggccaggggauuuaccaauugggauccccagcaacaaacgccauccgcaaucccauggcuaugcggucucuccauauccugagaaggguugugaaccaguuacugaaggagaaaaccauugacagcgaaacggagguccacaucgaauacgcccgagagcuaaaugaugcaaaccgccggugggcgauuaaccaguggcagagaaagcaagaaacucagaggaaggacuaugcugagaaaauacguaagguguacgccgaugaguuugaaaaaguaaucgagccgacacaggaagaacuccugaaguaucaacuuugggaagaacagcagcauuugugccuguacaccggcgagcagauuggucucacugacuucaucgggccuaauccccgcuaugauaucgaacacacaauuccacaaucaaugggcggagacaguacccggaugaaccugacguuaugugagagaaccuacaauaggacaguuaaaggcaaccgaaugccuucccagcuggcagaacaugagagcauacuuacucggaucaagcccuggaaagacaaguaugaagaguugaccgugaagauuaauaaacuccgcacacacccagggauggauaaggccucuaaagacaacaucauuagaaagaggcaucugcuagagcuggaacgggauuacugguuucagaaauaccagcgauucacuaugaccgagguccccgaaggauuuucacucagacaagguacaggcaucgggcugauaggaaaguaugcuggccuuuucuugaagagucuguuccaccacgugaaagagcgcaauaggaagcaggucuacgugaucaaagguccuauuaccgccgaguuucgucgguuaugggggcuccagaaccuguaugaacaaaagagcagagacaaucaugcacaccacugcaucgaugcuauuguuaucgccugcauaaacccagcggaguacgccaggauggcuuccuauuaccgccaggaagaggacuuccgacuuaauaaaggcaacaagccgguguuucccaagccuuggacuacguucacacaggaucugcaggcauuggaagccgagcuccugguaguccaugagaccagaaauaaccuaacuaaaaaggcucggaaaagggugcgcaccaagggaggcaauguucugucugaaucggacagcgcccgugggucccuccacaacgauacauauuacggagcaauucaaaaagacggugugaucagauacgucgugcggaaggcgcugucaagucuuucugagaaggauguaaaagacauuguggauaagaccguuagggaaaaaguccaggccgcuauccaggagaagggcgccaaagaagcauuggcugggacuauauauaugaacgaggagaagggaaucacaauuaaaaaggugcgcuguuuuacgaagaucgccagcccacuggcaauucgaagacaucgggacgccuccgcuaaagaauacaagaggcccuauuacgugaccaaugagucaaacuaugucaugggcaucuacgaagguugcauaaaagagaagacuaaacgcgaguucauuuuaguuaauaaccucgaggcggugagacagcugaaggccgcaaggaagcaaggggugguaagcucuauccuuccuccagucuccgcuaaaagucaguuuccccugaaguaucggcuauacacaggcacccucgugcuguuguacgagaauagcccggaagagaucgacuucacaaaccagguugauauuuguaaacgucuguauaaggugacuggauuaucuuccaugaccgucacgggcaaucaguacgggaccauccaacuccgcuaucaccaggaagcccgacaggccaaagaccugaaggcucagaacggagcauacaaggagggcgaggaacauagaccugccauuaugaugcuucacacacaauuuaaagcgcugguggaggguacugauuucaggaugaauauauugggggaaaucgagccacuccggaaguga

SEQ ID NO: 2895 - RNA, 3690 nt, Artificial Sequence
  Cas9 variant
augggcgacagaaaguacaaccuggggcucgauaucggaaccagcuccauugguuucgccgcuguggacgagaauaaccagcccauaagggucaaaggcaagacagcaaucgggguucggcuuuuugaagagggaaaaacugccgcggaucgccgaggcuuccguacgaccagaaggcggcugucucgcagaagguggcggauuaauuuguuaaacgaaaucuuugacgcucaccuggccgagguggauccuacauuccuagcacgccucaaggaaucaaaucgaaguaaccuggacccgaaaaagagcuuucaagguucccuucuguucccagagagaaaggauuaucaguuuuacgaggaauaucccacuauuuaccauuugaggaaagcccucauggagaaggaccggaaauucgauauccgugaaauauaucuggcuguacaccauaucauuaaguaccgcgggaauuuucugaacggaaccccuaugagaucuuucaaaguggagaauaucgagcucaacacauuauuugaccagcugaaucagcuuuaugcagaaauugucccagauaacgaguuggccuucgaccuggcucaaguggccgauguuaaggacgugcuaucgucaaccacuaucuacaagauggacaaaaagaaacagcucgucaagaugaugcugcuucccgcgagcaauaaagcacugcagagugaaaacaagaaaauagugacacaguuuguaaaugccauuuugaacuacaaguucaagcucgauguucuguuacaaguggagaccgacgcugauuggucccugaaacucaacgacgaaggcgccgaugacaaacuugaggaguucacgggcgaucuggacgaaaauagguuggagaucauugaucuacugcagcggcuccacaacugguuuucucugaaugaaaucacuaaggacgggaacagccuuuccgcagcuauggucgagaaguaugaaaaucaucaccaccaucugggauugcucaaaaaggugaucgagaaccacccugaugccaagaaagcgaaggcccugaaagagaccuacacagcauauguggguaagacugacgacaaaacccagaaucaggaugacuucuacaaggcugucgaaaagaacuuagaugacucaccagaugccaaaggcauuaagcgacugauacaacuagaccaguuuaugcccaaacagcgcacagggcaaaauggagcuaucccucaucagcuccaccagcaggagcuggaucaaauuaucgaaaagcagaguaaauauuacccauuccuugccgagccgaaccccaauguuaagagaaggaaggacgcaccuuauaaauuggaugaacugauagccuuuaagauuccauacuacgugggcccccucguaaccccugaggagcaggcucagaacaaagaaaauguguucgcguggaugaagcggaaagcagccgguccaaucacgcccuggaacuuugacgagaaggucgaucgcauggaaagcgcuaauagauucaucaggcguaugacuacaaaagacaccuaucuguuuggggaggaugugcuuccggccgagucuaugauuuaccaaaaguucguugugcugaacgaauugaacaaucucaagaucaacggacggcaccuguccuuaaaagacaagcaggacgucuauaaugaucuguuuaaacagcagaagacugugucaauuaaagcacuacaaaacuacuauguaacaaagaagaaagccgcuaccgccccuacgguuggcggccucgcagaccccaagaaauuccugagcagucuuucuaccuacauagauuuuaagaauauguucggggagcgagugaacgacccacaguuccaggaagauuuggagcagaucgucgaaugguccacaauuuuugaggacagaggaaucuucaaagcgaagcugcaagcucucgguuggcugagcgagaagcagauccagcaauuaguggccaaaagguauaagggcugggggcgccugucgaaaaaguugcuuacuggacucaaaaaugcagaaggcuacucuauucuggaugagauguggcgguccaccgaaaacuuuaugcagauacagucaagaccugaguucgccgcucuaauccagcaagccaaugaaaagcaguuugaggguaacgaccccgauaaugucugggagaacauugaaaauauccugggggacgcauacacaaguccacagaacaagaaagcuauucgccaggugguuaaggugguacaagauaucgagaaagccgucggcaaucccccugaaaagauagcgaucgaguucacuagggaagccgcugcaaacccacagcgaacccagagccggcuccguacacuggagaaacuuuaugaguccgccgaagaggugguugacgcuggauugaccgccgaacuggcagaguuuaaggagaacaaacauguguuaucugauaaguacuaucucuacuucacucagcugggcagagacgucuauacgggggacacaauuagccuugauaagcugaaugacuacgauguggaccacaucuugccgcaaucauuuauuaaagaugacagucucgauaacaggguacugaccauccgcgcggugaauaacggaaaguccgacaauguucccgccaaaauguucgguaagaaaaugggcagcuuuuggcggcaucuacuggauaacgggaugauaucuaagagaaaguauaauaaccucauuacugacccugauaauaucucaaaauacgcucagaagggauucauuaacaggcagcuggucgaaaccagucaagugaucaaacuuacagccaauauauugaacggcaucuacgacaaggacaccgagauuaucgaagugccagcaaaaaugaauagccagaugcgaaagauguuugaucuggucaagguucgcgaggugaacgacuaucaccaugcuuucgaugccuacuuaacuauuuucaucgguaauuaucucuacaaaugcuaucccaagcugcggccuuacuuuguguaugacaacuucaaaaaguuugggaacaaagaagauauaggccacaagagauucaauuuucuuggaaagauugagagggagaaaaagguagucgcaccagaaacaggcgagauccugugguccaacguggcccccaaugaaacgaucaaacagauuaagaaaguuuacaacuacaaguucaugaucgugucucgugagauuaccacucgccgggcugaacuauuuaaucagacagucuauccgaagaacuacagagggaaacucauaccuaucaaggaggacaggccaaccgaucuguauggagguuacucgggcaauacagacgcguauuuggccauuguggcacuggaggauaaaaagaaagggaaguacuucaaaguugugggaauccccacucgagcugccgccaaguuagaaaagcucaaacaacaggacagccagcaguaucugcaagcacuucacgagguaauugcuccucaguuuaccaaguccacgaaaaagggcaucaaaaagaccgaguucgaaauaguccuggauaaggugcauuaccggcaguuggugcaggacggucccgucaaaaugaugcucgggucaaguacauacaaguauaacgccaaacaacugguucuaucugaaaaggcgcuguga

SEQ ID NO: 2896 - RNA, 3696 nt, Artificial Sequence
  Cas9 variant
augaucaccaggauucugggccucgacacagggacuaacagccuugccugggcuguggucgauagggacgcaaauggaaacuacacgcugguuaagcggggugaugugauauucaccgagggcguaaaaaucgaaaaggggauugaguccucuaaagccgcggaacgcacagcucacaaggccuugcgagugcauuauucacguagaagguuacacaaaaucgacacucugaagguccuaguggagcucgaucugugccccuaccuuaguaaugaacagcugaacuuguggaaggccaaaaagaccuauccucucacagacgauuuuaugcuguggcaacggagcggauccgcagaggagaauaacccauacuauugucgccauagaugccugacccagaaacucgacuuaacugaucagucucagagguuccugcuuggccgggcuuuuuaccacuuggcacaacgccgagguuuccugucgaauagacuagacacaucagccgauagcgacgaaagugggaagguuaaauccggaauugcugagcucucuguggaaauggagaaggccggcugugaguuucugggcgaauauuucuaccagcuuuacaagcagcaugggaacaccaucaaacugaggagccgguauacggaucgugaggaacacuacaagaaagaguuuuuggcgauaugcgaaaagcaggagcucgacccgaaaugggucgaggcacugcaacgcgccaucuauuuccagagacccuuaaagucccagaggaaaggaguggguaaguguacuuuugaaccuaagaaaccacggugcgcugagucacaccccgacuacgaagccuuccgaaugcuguguuuucucaauaacguaaagauucagaccccuaaugauacaagucuucgcccacugaacgaggacgaaagagagaaaaucuggcccuuguucuuuagaaagagcaaaccuaauuucgauuucgaggacauugcaaaggcucuagccggcaagaacaauuaugcgugguacaaagaugccggggaaaagccauuuaaauucaacuaucggaugcaacagggaguuucuggcugcccggugacugcacagcugaucgacauauuugguuccgauuggcaaaccgcuauugccgagacauacaccgcugucgaaaagaaaaacgggacgaagacuaucgacgagauggccgaugacguguggaaugugcucuacucauucagcaguaaggauaaacugaaggcauuugccacagaaaaacuucagcuggacgaggcuucugcgaccaaguucgcaaacgccaaauugccccauggauuugcuucccucagccugaaggccauucgcaauaucuuaccuuuccugagacagggcuuuaucuaugcacacgccguccaucuagcuaagauuccagacauaguuacuaaagccguguggaacgaugcagacaagagggagaugauccucucgggccugauggaaauuaucgagaauuacaaccccaaagaucgugggguagaaggaacaauagacuucuguauuaagucucaccuucaggaugugaucgacuugcggccuggugcggcugaugcccuguaucacccauccaugaucgagaccuaccccgacgcaaaacucaauaagaugggcgucuuucaacuggggucaccgcgaacgaacgccauuagaaauccuauggcuaugaggagucuucauauccugcgcagcgugguuaaccaguugcuccgggauggaauuauagacagaaauaccgaggugcacgucgaauaugccagggagcugaacgaugcaaauaaacgcaaggcuaucgccgacuaccagcgagaacaggagaagaaacggaagcaauaucgugaugacauuaucgcguuauacaaauccgaaugccauaaggagaucgagcccacagacacugauauucugaaauuccagcuaugggaggaacaggaccaccucugucuguacaccggcacacagauagguaucugcgauuuucuuggggacaacccaaaguucgauauugaacauacugugccuagaucuguaggcggagacagcacccaaaugaauuugacacugugcgaugccaccuucaacaggcagguuaagggcgcucagcuccccucacagcugaguaaccacgcagacaucuuagugcgcauugaucacuggaaauccaagugugaggaccugcggaaacaacuugauaagaucagaacuuaugggggaauggaaaaagccaugaaggacagguugauacagaagcgacaucgccucaaaauggaucuggacuacuggcaggguaaguauagccgguuuacgaugacagaggucccagagggcuucucuagaaggcaaggggcuggaaucggccuagugucaaaauacgccggucuguuucucaagagucuguuccacaaugaacagaaccccaauaaaagcaacgucuaugugguuaagggggugaccacugcagaguuucgucgcauguggggccuucagggagaauacgagaagaaaucccgguugaaucauugccaccacuguauugacgcgaucaccauugccugcaucggcaaggcugaauaugauaaaauggcccaguacuaccaugacgaggagcuguuccaauggagagggacaaccacuaagccucacuuuaacaaaccauggccgacauucacggaagauguauuagcaauagagcagucucuccuggucaagcaucuuaccaaagacaauaugcccaagcaggcuaagaaaagggugcgaacugccacaggaaaguaucuggcacagggugauaccgcccggggcucguugcacaaagacacauacuauggggcuauugaacaagauggagagauccgcuacguucucagaaagccucugaacaaauuugagaaugaagcggagcuagaaaagauuguggaccaggccgucaaggagaaaaucaaggaagcaauagcuggcaaaaacuucaagacugccaucaccgagccaauuuuuaugaauaaagagaaggguaucaggauuaacaaggugcgguauuacguaaaagcccaggaacgacugaagaucagacagcaacgcgaucucagcuccaaagaguauaagcaguucuuuuguguggaaaaugagucaaacuaccugcuugcuauauacgaaggggaguugaaaggcaagaaggagagggacuucugcguugucaauaaccuggaaagugcagccuguuuaaaacguucuaacaagggaaaagcggcuccccucgugccugagcggagcgaagagagaaaucugccacuucuggccgugcuaaagaggggcacgcagguccucuucuaugaaaacucccccgaggagauucuguuugauaauccgcaagacuugguucgccgacuguacaaagugaccgggaucaacacaaagaaggacgugaaaaauggaaagacuuauuuauacggcaacaucgaacucagauuccaucagaaugcacagaaaaaggaugacguaaaaaugcagucaggugucuauaagaacaaugaggugcugcggcaagggauuguucuuagccacaaacaguuuaaggcccugguggaaggagucgauuucgaguuuaacguguugggcgagaucaagaaaaaggaaaggcacgcuuga

SEQ ID NO: 2897 - RNA, 3699 nt, Artificial Sequence
  Cas9 variant
augaccaagacaagaauccugggccucgacacugggacgaacagccuuggaugggccauuguggauagggacgaggucuccggucaguacgaacugguugaucggggcgacuugauauucaccgagggggugaaaaucgaaaagggaauugagucuucaaaagcuagugaacgcacacaacaccgagcauuacguaagcaguauuuuagaaggcggcugcgcaaaaucgagguacuaagagugcucacuuucuaccaucugugucccccugucagcgaggaagaacuucaccuguggcaugugaagaagauuuauccaguugaaaaucacgaguuuaugaucuggcagaggaccaacgauaaugagggcaaaaacccguacuauuaccggcauauaugcuugcacacaaagcucaaucugacccugaugaaagaccgcuauauccucggucgagccuuauaccaccugucccagagaaggggguuccuuucuaaccgguuggaucaaucgcaggacgaagaugacaagggaacugugaaaacaggcauuucaagccugaguaaggauaugaaugacgcgggcugcaccuaccuaggggauuauuuuuacaagcucuauuccgagaacggaaaucguguccgcaucagaaaccauuacacggcuaggaaugaacacuaucuggccgaguucgaagcaauuugucaggugcagaaacuugagcccgagcugguagaagccuugcggcgagcuaucuuuuuccaacgcccucucaagucucagagaaaagguguuggcaagugcacuuuugagccaaggaaaccccggugugcagacagccauccugacuacgaagaguuccgcaagcugugcuuuauaaacaauauuaaaauccagaccuccgaugacgauacaaugagaccauuaaacaaggaagagaggcagcguauuaauucacuguucuaucgggugaguaaggccaacuuuuacuucgaggaaaucgcuaaacuccuugggggacgaaacaauuacuguuauuucaaggacgagguccaaaaagauuuuaaguucaacuacagaaugagccagucuguguccggcugccccacuaccgcccagcugaggaauaucuuuggugaagacuggaaaacagggauugcggagaccuaucaacacucagcaaagaaggauggcagcuugaaaacgguggacgaaauggccgaugacauauggaacguccuauacaguuucucuuccaaggauugucuguauaauuuugcuguuaacaaacuccagcuggaggaggacaaggccaaaaaguucagcaagaucaaacuuucgcacggauuugcaucuauuucccugaaugcuauccauaagauauugccuuuccuccgcaugggcaugauuuacucacacgccgugcuguuugcgaacaucccaacuaucguagggauggacguguggaaugaugaaaguaaacggcagcauauuaugacagaguuaagcgaccuggucuucaacuaugauccgaagaauagagaaguggagggaaccaucgagaugugcauuaaagacuuucuacucaacaauuacgaucugcccgccggugcaguuuguaggcuuuaccacccuuccaugauagacacuuauccagaugcuaaggccaacaaguacggcguguugcagcuggggucucccgcuacaaaugccauccgcaacccuauggcaaugcgaagccuccaugaacugcggcacgucgugaaccuucuguugcguaaaggaaagauugaccaaaauaccgagguacacguugaauaugccagagagcucaacgaugcuaauaaaaggaaggcgaucgcagaccgccagcgggaacuggauaaauuacauaagaaauaccacgacgauaucauuacgcuguauaaggaggagaccggcaaggacauaaacccaacacaggccgacauccuaaaauuccagcucugggaggagcaagaacaugugugccuguacacugguagacagauugggaucucaaaguuucuuggccccgauccggaguucgacauugaacacaccgucccuaggagugugggaggcgauuccacacagaugaauaugacuuugugcgaccgacgcuucaaccgggaugucaaaaaggcuaugcugcccagccagcucccaaauuaucaagagauccugccuagaauagagaaauggaagaagaaauacgaaaaguuaaccaaagacaucgaucacuguauuacacauucugggaugaccaaggaggccaaagacucaaucauucagaagaggcaccgucugacucuugaacaugauuacuggcgcaacaaguauagucgguuuacgaugacagaggugcccgaaggauucagcagaaggcagggugcaggcaucggguugguuuccaaauacgccggacucuuucugaagucucuauuccacgacccaaccgaucgacggcgcucgcauguguauguagucaaaggcacuaccacagcugaguuuagaaagauguggggucugcagagcgaguacgagaaaaaguccagggacaaucacgugcaccauugcguugaugccauaaccauugcauguaucgggaagaacgaauauaauaaaauggcgucauucuaccacgacgaagaggcuuuugagcggggcgaaugcgagaagccccauuucgacaaaccuuggccaacuuuuacacaagaugugcucggacuggaaaagcgacuuauugucgugcacaguacgcaggacaacaugccgaaacaugccaagaaauauguaagaacuccccgcggcaaguucaucgcaaagggggauugugccaggggaucuuugcaccuggacaccuacuacggugcuauaaaacacaaggaugacacagagccucguuauguguuacggagagaacucagcuccuuugauucaguuaaugaccuggauaucauugucgacgaugccgugagggagaaaaucaaggaggcagugaaaggcaagagcgggaaggcuuucaaagaagcccuugcgaacgucuacaugaauaaggagaaagacauucgcaucaagaaaguucgaugcuaugugccaucugugaagagacccauagacauucggcaucagagggauaugucccgcuuugacuacaagcgucaauuccacguagccaacgauggaaacuauaugauggcuaucuacgaaggcgucgugaaagguaagcugaaaagagacuucgaguugguuaagaauaucgaagcagccaguuauuuuaaagugagccaggauaacgagucuuucuccucaauugucccugagaagaguagcaauggguuuccacucaaggcugugcugaaaaucggcacccauguucuacuguacgaaaacacagccucggagauugacuucuccgaucccguggaccucacucggaggcuguacaagguagucggacuuucuagcgcaauaaucaauaacuguucauauggcuuuauuaccuugcgcuuccaccaggaagcgcgacaggccaaaaaucugaaguuaacgaaagggguguuuaagaacguggauaauuacagaggagcuaucauucucuaucacacccaacugaaggcccuugucgagggcuacgacuucgauaucaacauacugggugaaaucacaaguaaacaguga

SEQ ID NO: 2898 - RNA, 3705 nt, Artificial Sequence
  Cas9 variant
augcccaacuucuggagcaucuuuaccgagaaucugcagacauaccucaugaagacuagaauuuuaggccuggacacggggaccaacuccuugggaugggccguggucgauagggacgaaaauaaccaauauacaccuauaugccggggugauuuaaucuucacugagggcguuaaacaggaaaaggggauugaguuuucucuggcugcagaacgcaccucauaccgagccagucguagacacuauuucaggcggcgccuaagaaaaguggagguacucaaggugcuggucaaacauaaacuuuguccaccgcugagcgacgaggcguugaauagguggcacacaaagaaagaauacccccucgaugaggacuuuauccuguggcagcggaccaacgaagcugauaauaagaacccuuaucaugaccgccacauuugccugcaucgaaaacucaauuuaaaggauucccagacugacagauacacacugggaagggcccuuuaucacuugacccaacggcguggcuuccugucuaaccgccuagaucagaaugaggaggcagaagagacggguaaagugaagucggccaucucagaacucagcaaggagaugaaagaagcugggugugaguuucugggagacuacuucuaccuucuguauagaacugagggcaacaggguucggauacgaagucgcuacaccgauagagaaaagcacuauuugcaggaguuuaaagaaaucugcagggugcaggagcucgacgaagaccuggcaaaggccuuagagaaaacaauuuucuuucaacggccacugaagucccagcgccagggcgucgggaaauguacuauggagaagggacauucuagaugcgcugugagccacccccucuacgaagaguauaggcuucuguguuacuugaauaacauccguauuaagaccccuuccgaugaccggcuacgaccacugaaugccgaagagagagaaaagaucacaccccucuucuauaaggagaaaaacuuugauuucgagaagauagcgaaaaagcuggcagguaagaccccuuucggcuggauuagggacgccgaagauuggccauaccaguuuaacuaccgcaugacgcaagaggcuccggccugccccacuacagcacagcuuaucaaaguauucggggaagacuggaaggcugcccuggcggagaccuauacuaugucagccaaacaggauggaacauugaagaccgaggacgaaauuuguacggauaucuggaauguucucuacaguuuuagcucuaaagagaagcugaaggaguucggccuuaaaaagcugcaacuagacgaagugcaggcaaaggcuuuuuccgaaauccggcucaccagagauuucgccucacugagccuuaaggcuauuaggaaaauauuguuuuuccugcgcacaggugaggacuauaguaaggccaucuuucucgcaaacauuccuacuaucgucggggaggaaauauggaaugacauugagcgacggucucgucugcuuuacaagguggaucuggccuugagaccacaggaagagagggacgcugaggaacaucgcaccaucgcggagcggaucaaagcagccguggcugccgaaguccccgaugcaccuauugaccuccuguaucacccauccaugaucgaggccuaccccgaugcuaagagaaacgaaagguucgacugcuaucaguuaggaagcccgaaaacaaaugccguucgaaacccuauggcaaugcgcucgcugcacauggugcggaagguaauuaaucaucuacucagaaaacacauaaucgaugagaagacugaaauucauaucgaguacgcgagggagcugaacgacgcuaauaaacgucaagccaucgcagauuggcagcgcgaacuuucuaagcggcacaccgccuacgcucagaacauuagacaguuguauaaggccgagacaggccuggugauagaacccaccaaagcagacauccucaaguaccaacugugggaggagcagcagcaugucuguuuauauacuggcaaaaagauugggaucgcugauuuucugggagccaauccaaaauucgacauugaacacacgaucccuaggucccgagguggcgauucaacacaggagaaccuuaccuugugcgaaaguaaguuuaaucgggacauaaagcgcgacaaacuccccacugagcuggcgaacuacgaagagauccuagccagaauugagcacuggaagaaacaaugcuaugcucugaagcucaaaagggaugggauccggacccauagcggacuggaaaaguccauuaaggacucucgaaucagacgcaggcaccuugugggcuuggaguacgguuaucugaaagggaaguacgaucguuucacaaugaaagaaguuccagagggcuucagccggagacagggagcaggcauaggguuaauuucaaaguacgccggacucuuucugaaaagucuuuucaaggaccccaagaauccuaacagguccaacguguaugucgugaaaggugcuaucaccgccgaauuucgcaagcuguggggcuugcagcaggcagaugaggcgaaaagccgagagaaucauacucaccacuguauugacgccuacacaaucgcuugcauagggccaugugaauaugccgcacucgcugccuacuauagaucugaugaggaguucaaguacggacggaggcgcgaaaaaccgcaauuugaaaagcccuggccuacguucaccgaggaccugcuaaaacugcaggaggaacuccugaucguacaucagacuacagauaaacuuggcaagcgugacagacggaaaguuaagaccccaagggguaaauuuuugacagggggcgauucagcacgcggacgacugcaccaagagacuuauuacggcgccauuaacuacgacgggaauaucaaguauguggucagaaaacccuuagauagucucaccgaaaaggaccuggacaagauuguggaugagacggucaugggaaucgugaaaggugcuguugaggcgaagggcagccuuaaagaagcccuggcagacgggauauacaugaacaaggagaaaggcauucuaaucaagcgggugaggaucuucuccgauguaucugaaccuauuaaucucaagcagcugcgcgacgucucgaccaaagaguauaagagacauauccacuugaggaaagaugaaaacuaccuguuugcuauuuaugagggaauagacaagaaaaagaauaagaaacagacagagacugccaccguggauuacuuagacgccgcuaaguucuauaaagauagcaagcggcgugacaaagcaaacucccucguuggugauuacucaaagaagaauaaacugccacuuaagugcauccugaaaaagcgccagaugguguuguuuuacgaacauagucccgaggaaauucgauucaaagacaagaaagaccucucuagaaggcuguauaucgucacaagcauugccaaggaugggcgggugaaguuucuacaccaccaagcggcuacugccaccggcauccaguccucaccgagcccuuucacgaacgacggagagcaucagccauacuaucgccugucugcauccaauauaaaaguacuuguggccggcaucgauuucgacauuaacauccucggggaaauuacacccaagcuguga

SEQ ID NO: 2899 - RNA, 3711 nt, Artificial Sequence
  Cas9 variant
auguacuucuauaagaacaaagagaauaagcugaacaaaaaggugguccucggccuugaccuggggaucgccagcguuggauggugcuugaccgauauuucccagaaagaagacaauaaguuucccauaaucuuacacggugugagacuguucgagacaguagaugacucugaugacaagcuacucaacgaaacuaggcggaaaaagcgcggccaacgacguagaaauaggcggcuguuuacgcgcaaaagagauuucauuaaguaccuuaucgacaacaauauuaucgagcuggaauuugauaaaaacccuaagauauuggugaggaauuucaucgagaaguauauuaacccauuuucaaagaaucucgagcugaaguacaaaagugucaccaaccugccgaucggguuccauaaucuccggaaggcugcaauuaacgaaaaauauaaguuagacaaaagcgagcugaucgugcuuuuguacuuuuaucugucccuacgcggagccuucuuugauaaucccgaagacacaaagucuaaggagaugaacaaaaacgagauagaaauuuucgauaagaaugagucgaucaaaaacgcggaauuuccuauugacaagaucaucgaguucuacaaaauuucaggcaagauacgaagcacuaucaaucucaaguucggucaccaggacuaccugaaagaaauuaagcagguuuuugagaaacagaacaucgauuucaugaauuaugagaaguuugcuauggaagagaaaaguuucuuuuccagaauaaggaacuacucugaagggccaggaaaugaaaagagcuucuccaaguauggccuuuacgccaacgaaaauggcaaccccgagcugauuaucaaugagaaagggcaaaagaucuauaccaaaauuuuuaagacauugugggaaucaaaaaucggaaaguguaguuacgacaagaaacucuaucgggcaccuaagaacagcuucucugccaaaguguuugauauuaccaauaagcugacugacuggaaacauaagaacgaguacauauccgaacguuuaaaacgcaagauccugcucucaagauuccuuaauaaggauagcaaaagugcugucgagaagauucugaaagaagagaacaucaaguuugagaacuugucugaaaucgcauacaauaaagacgauaacaagauuaaucuaccaauaaucaacgccuaucacucccugacaaccauuuucaagaaacaucucaucaauuuugagaacuaccugauuagcaaugaaaacgaccuuucgaagcugaugucuuucuauaaacagcaguccgagaaguuguucgugcccaaugagaaagguucauacgaaaucaaccagaauaacaauguacuccacauauuugaugcuaucaguaacauucugaauaaguucagcacgauccaagacaggauucggaucuuagagggcuauuuugaauuuuccaaccugaagaaagauguuaagucuagcgagauauacucagaaauugccaaacuacgagaguuuagugggacuuccagccucucuuucggagcguauuacaaguuuaucccuaaccugauuucagagggcaguaaaaauuacagcaccaucuccuaugaagagaaggcacuucagaaccagaagaauaacuucucucacucgaauuuguuugagaaaacauggguggaggaccugauagccagcccaacugucaagcgcucccucagacagaccaugaaccugcuuaaagaaaucuucaaguacucagagaaaaauaaccuggagauugaaaagaucgugguggaggucacaaggaguucuaauaacaaacaugaacggaagaagauugaggguaucaauaaauaucgcaaggaaaaauacgaggaguugaagaaaguuuaugaccucccgaacgaaaauaccacgcuguuaaagaagcuguggcuacucagacaacagcagggguacgaugcuuauagccugaggaaaauagaggccaacgacgugauuaauaagcccuggaacuacgauaucgaccacaucguaccucguuccauuucauuugaugacagcuucucuaaccuugugaucgucaauaaauuggauaacgcaaagaaauccaaugaccugagugcuaagcaauuuauugaaaagauauacggaaucgagaaacucaaggaggccaaagaaaacuggggcaauugguaucugcggaacgcgaauggcaaggccuucaacgauaaagggaaguucauuaaguuauacacuaucgacaaucuggaugaguuugacaacagcgauuucauuaaucgaaaccuuucugacacauccuauaucaccaaugcauuggugaaccaucucacuuuuucaaauaguaaauacaaguauagcguugugucggucaacggaaaacagacauccaaucugagaaaccagauagcuuucguggguaucaagaacaauaaagaaaccgagagggaauggaagcgcccagagggcuuuaagucuauuaacagcaaugacuuccuaauccgggaggaagggaaaaacgauguaaaggacgauguucugauuaaagacagaucauuuaauggacaccacgccgaggaugcuuacuucaucacgauaauuagucaguauuuuagguccuucaagcgcaucgaacgacucaacgugaauuaccggaaagagacccgugaacuggacgaucuugagaagaacaauaucaaauuuaaggagaaggccucuuucgacaacuucuugcugauuaaugcauuagaugaacucaacgagaaacugaaucaaaugagauuuagcaggauggucauaacaaagaaaaacacucagcuuuucaaugaaacccuguacuccggcaaguaugacaaagguaagaacacaaucaagaaaguggagaaguugaaccuccuggauaaucgcacugacaaaauuaagaaaaucgaagaguuuuucgaugaggacaagcuaaaggaaaacgagcugaccaaacuccauauuuuuaaucacgacaagaaccuguacgaaacacuuaaaaucauauggaaugaggucaagaucgagauuaaaaacaagaauuugaacgaaaagaauuauuucaaauacuuugugaacaagaaacugcaggaggggaagaucucauucaaugaauggguucccauuuuagauaacgacuuuaaaaucauacggaagauuagauauaucaaauucagcagugaggaaaaggagaccgaugagaucauuuucucucaguccaauuuccucaagaucgaccaaaggcagaacuuuagcuuccauaauacucuguacugggugcagauauggguauauaaaaaccagaaggaucaauacugcuucauuucgaucgacgcccgaaacucaaaauuugaaaaggaugagauuaaaaucaauuacgaaaaacuuaagacgcagaaagagaagcugcagauaauuaacgaggaaccuauccuaaaaaucaauaagggcgaccucuucgagaacgaagagaaagaacuguuuuauauugucggacgcgaugagaagccacagaaguuggaaaucaaauacauucugggcaagaaaauaaaggaccaaaaacagauccagaagcccgugaagaaauauuucccgaauuggaagaaaguuaacuuaacauacaugggggagauuuuuaagaaauga

SEQ ID NO: 2900 - RNA, 3717 nt, Artificial Sequence
  Cas9 variant
augaccaaggugcugggccucgaccuuggggccgcuagcgucggaugggcaaugaucgaggaagaggaaaaaucccacaagauucuggguuugggcucuagaauaauccccuacgaggggacagaaggaaacgauuucgccaaaggcacuggugagucaaggaaugcguuacggacgaaggcucgcaccgcccgaaaaggguaugaccguuaccagcugagaaggaaguaucuaguugauacacucgugaagaacgagaugaugccugacgaauaccugcggaaacuuccaaagaugcaacugugggaguugcgcaguaaagcaguaacuaccgaaauuacaaagcaggagcucggaagacuguuucuguggcucaaucagaaaaggggcuauaagagcucccggucugaugccaacuuagacaagaaagauaccgaguacguggucgaagugaagucgcgccaugagaaaaucaaggaaucaggcuucacuauugggcaguauuuuuacagcgagcugaaaaguaaugaauacuuccgaguuaaggagaacaucuuuccgagagaggcuuauauagaagaguucgacgcaaucugcaaacaacagaagaggcaccuuacagauaaguugauuucccggauccguaaugaaauuaucuacuaucagcgcccccugaaaucucagaagggacuugugagcgucuguagauuugaggguuucuuuaaaaagggcauaaacgggaaagaauacuucgugggaccuaagguagccccaaaguccucaccccucuuucaaaccguuaaaauuugggagaauaucaacaguauuaggcugagcgaccggaauggcaaggagaucaugcuuucucuggaacagaaaaagugcaucuucaaccauuuggauaauaacgagaaacucacgccuaaggaccuguuuauuauaaucggugugaagaaagaaaauuguuucgucaacaagcaguuagagaaagggauucagggaaacgugacuaaguccaccauccugaaaugcuucggcgaaaauaacgauuaugacaaguggcucaaacuugaccugaauauaauugugaaaaaggauacauuuggcuacuuguaugacaaaaagacuggggagaucaucggagagaaacuaauuaagcacgucgauucagcuguugaacgagagccacuguaccaacucuggcauaccaucuacagcauuaacaauacagacgaauguagugccgcgcugcagaacaaauucgguuuugauucugagaccgcagacaaacuuuccaauauagauuucggcaaggccggguuuggaaacaagagcgcuaaggugauccgcaaaauucugcccuauuugauggagggcgacgauuacucgcagucuauguccuaugccgguuucaaucacucagacagucucacgaaggaugaaaaccugaaaagaaaguuacuggacaagcuaaggccuaucgagaaaaauagccuccggcaaccaaucguagaaaagauucugaaccagauggugaaugucgugaacgcaauaaucgacaaauacgggaagccggaugagauucgcaucgaacuugcuagagaguugaaacagaauaaggaggaaaggaacaagacugacaaagauauguccaagcgucagcgggagaacggcgaaauuucuaaacgacuggccgaguauggacucagagcgacaaggaauaacaucauaaaguggcgccuguacgaagagaucgacaaucaagauaaaaagcuaaacgccauuugcguuuauuguggccagcccaucagccugaccgaggcaauuaaggggaaugaaguggacgucgagcacaucauaccuaaaucaaaguuguuugaugacagucaguccaacaaaacucucgcucaucggagaugcaauagcacaaagggagauaugaccgccuacgacuucauggaaaacaaaccagcucagguguuuaaugccuacauugagaggguaaacaugcuguaugauaauaagaucauucgcaaaguuaagcgagacaaguuacugaugcccgaaucuaaaaucccugauaacuucauagaccggcaacuacgugagucacaguacaucgcaaguaaggccagagagauucuccagacgaucuguuauaauguguggagcaccuccgguacagucacugcuaggcugcgccaccuuuggggcugggacgaugcgaccaugucuuugcagcugccaaaauaccgggaacucgggcugacagagaugguggaaugggagucggagcauggaaagcaaaaacacagcaaggaagucauuuccgacuggucaaagagagaugaccacaggcaucacgcaguggaugccuuaacuaucgcuugcaccaaacagggcuuuauacagcgauucaacacacugaauaguucuaagaccaaagaggacauggaauuugagauugccaaguguagcaucgaauaucgcgagaaccuuuccaaauuggagaaguacaucauugcacuccggcccaucccgguuucagaaguggaggaugccguagcuaacauucugaucagcuucaagucugguaaaaaggucgccgugaaagggaagagaaaaauaggcaagaggggaaauaagaaaauuauccagacugacauuaucauaccucauggcucccuaagugaagagagcguuuaugggaagaucaaaacgauugaacgugagaagccccugaaauaccucuuccaaaacucucagcugaucuuuaauaacaagauuaagauccuuguggaggaacgcuuggcaacauucgagaaugauaccaaaaaggcgcuggcuuccuuaaagaaggucccaguguaccucgacgaagagaaaacuauaguacuggaauaugcaaccugcuuuaaggaggaguacgugaaaaaguaugauguugacacaaacuucucaaagaccgauaaagucauugacgacaagaucaaagaaauccuucagcaccggcugggaaaguuugguggcaaagccaaggagaaggaagccuucaaagaugugcaacagggggacaagacuauuaaaugguacgaggaugagggauuggaaagaccuauacauagugugaggugcuuuacaggccucagcgcuaucguccccguuaagaaagacgagaaugguauugauaucggguucgugaagccaggcaacaaucaccacauugccaucuauucggacaaggauggaaaccgauacgaacauauauguacguuuuggcacgcaguggagcggaaaaaguaugacauccccguagucauuaaagauuccaaugaaaucuggaacaagauuuggucuaaaccugagggcagcuacccacagucauuccuggacaagcuaccgcaggagaaucugacccucgaucugaguaugcaacagaacgaaaugcuuaucuuggggauguccuacgaggacauaaagacugcuauugacaauucugauuauaaacagcugagcuccaacuuauaccgccuccagaagcuggccaacgcgaauuauauguuuagacaucaccuugaaacacaaaucaucgacgauaacaauucaaaagccagcaggcgguucauuaacauccacagucugaaggcucuauuugcauggaaucccuacaaagugaacauaaauugccucggagacauucagaccaacucucgauga

SEQ ID NO: 2901 - RNA, 3720 nt, Artificial Sequence
  Cas9 variant
augaccgagaagagaaaauucgacaucagggaaguguaccuggccauucaccauauagucaaguaucggggcaacuuucucaauagcgcuacaguugauuccuucaaaacuucuaacaucgacuuuacgucacaguucgaucgccuuaaugagcuguaccgacaagugauuuuggaagaacccuuucagaucaacaugaaucagguagacaagaugaccaacaaauuacuggauaaugacgcacuaaagcucgauacacagaagcaaguggccaaacugcuuccugucauuuauaacgacaagccaguggauaaacaguacacucgucuggcgaccgaauuuaguaaggcuaucuugggguauaaaacaaagcucgacguuauacugaaucuggauacccagaacgccaaggacugggcaaucagacucgaugacgaggacauugaugacaaauuaccggcccugguggagaaucuugaugaaagcaggcaggagaucgucacuauuauccgggacuuguacgcucaaauaacacugaacgcaauugugcccaagggaaaaucccuaucugaaucgaugguagauaaguauaaugaccacaaagaucaucucgaccugcuuaugggucugauccacgaguugggcgaugacucagccaaggggauuaaacuccgcgaggcuuacacccaguacguuggaaagagcggcgauaagacgcugaaccaggacgacuuuuaugccgcgaucaaaaagaauuuagaugaagacaguaaaagauccccuaagauccagaggcugauugagcaagcaucuuucaugccaaaacagcggacuagcgccaacggugugauaccccaucagcuccaccaacuugaacuggaucgcaucauugagaaccaggggcgauacuauccuuucuugaaggaaccaaauuccaacacccacaagcccaauggaggcaaauacaagcuagacgagcuggucgcuuucagaaucccuuauuacgugggcccacucauaacaaaacaggaucaggagaagacuucaggggccgacuuugcauggaugauuaggaaaccgggacaagguggcgaaaucacccccuggaacuucgaucaggagguggaccggauggcuagugccaauacauuuauccgucgcaugaccacgaaggauagcuaucuggucgcggaagacguucuuccugauucuucccugauuuacgagaaguucaaaguguugaacgaacucaauaugcugaagguaaacgacagaagguuaucaaucagccagaaacaggaucuguucaauaaccuauuuaagaaacaaaagacuauucggacaaagaaacuccagaccuacauacgaacuaagugggagcugccaagugugaugaucucugggcuuuccgaccccgacaaauucaauagcucguuggccacauauauugauuuucgcgacgucuucggagagaagguggaugacccuaacagacaggcagauuacgagaaaaucaucgaguggucuaccguuuuugaagacaggaagauuuaucaggcuaaacugaaucaacucgauuggcugacggagucccagucaaaggcccuucugaccaagcauuacacaggcuggggucgguugaguaaaaagcuccugacuggguuaaaagaccagaacggagauagcauacuggaccagcuauggaagaccaaugauaacuucaugcaaauccagucccgcgacgaauuugcuaaacagauucacgaugagaacgccaagcaauuccaugaggcaaauaacguggacgacauccucgaugacgccuuuacaucuccacagaauaagaaagcuauuagacaggucgauaaggugguacaggacguugugaaagcggucggcuaugcacccgauaagaucgccauagaguucacuaggagcccgcaagaccguccucagcggaccuuuucacgacagagacagcugcaaaguacauaccuuaacguggcuaaagccuugaugaaguccaaucugaaccaggaacucaagagcgucaucgauucucagcagacccugacugacaaauuauaucuguacuucacgcaacuuggccaggauauguacacagggaaggaaauuaauuuugacgaguuggugaacuaucagaucgaucacauucucccccaagcauucaucaaagacgacucacuggauaauaggguucuagugagugccccaauaaacaaugcuaagagcgacaacguaccugucaaaaaguucggagccaagauggguuacuuuuggaaacagcuggcagagaaucaccucauuuccaagcgcaaacugaacaaucuuaccacugaucccgacaagaucggcaaauucaccgcgcagggguuuauucaucggcaguugguggaaacaucucaaguuaucagacugguggcuaacauauuaggaaacgaguauggccacgaugguaccacuaucauugaagucacagccaagaugaaucaucagaugaggaaagacuucgaucucaucaagauucgcgacgugaacgauuaccaccaugcaauggacgccuaucugacggcuuacguaggggauuaucuuuaccugcgauacccaaaguugcggucguauuuuguguacggcgacuucaaaaagcucaaagaucagagccugaagauccguaauuuuaacuuccuacacgaccugaccaaugacgaggccggagauaaaauaguugaccaggaaacuggcgagauuaucugggauaagcacgaguccgucaagcaacucaaaaagguguaucauuacaaauuuaugcuggugucacaggaagucuauacaagacaggacgcacuuuucaaccagaccaucuaccccgcuagugaugccgacaagaggaaauugauuccuaucaagaauaacaagccaguugauguguaugggggauacucugguaauguggacgcguacauggccauuguacgcauacacggcaaaaaggaggauaaauauaaggucguggggguuccgaugcgggcuguggcagaccugaaaaaggccgaaagcaagggaagagauaacuacuuaaaugcuguccaugaggugcucaaaccccaauuuacaaagaaaaagaaagacaggaagacuggcgaaaucaccgagaugauggaugacuucgacguucugcuugguaagguguauuaccgacagcugauuguagaugggaacaaaaaguuuaugcuaggcuccucaacguaucaguacaaugccaaacagcucguccugagcgacaaggcaaugcaaguguugucuaaagaugacaagcugaaaaaccaggaugagaaucagaacuuaaucgacguguaugaugaaauucucgagaaggucgaccaauacuucgaacuguacgauaucaacaaguuccgccagaaacuucacgacggacggaagaaauuuauagagcugccuguugauaaugacuucaacggcaagaaauugaucuccuaugggaagagagcgaccauuaucaguauucucaauggacugcacgccaacgcuacaaugagcaaucuaaaguaccuggguaucucuuccccauuuggcaugcuucaggugcccaacgggauaauucucaguccugccucaaggaucugcuaucagagcccaacuggacuguucgaacguaaaguaaaguugucggaccuguga

SEQ ID NO: 2902 - RNA, 3738 nt, Artificial Sequence
  Cas9 variant
augaucauuuacuucauauuugagaagaucgugaacaccauucuggucaugaaaaagaucguuggccucgaccuugggacaaauagcauuggaugggcccugaucaacgcuuauauagaugaauacaauaaagagcacuuguaugguaucgaagcaugcggcuccagaauuauccccauggacgccgcgauuuuagggaacuucgauaagggaaauucuaucucacagacugcugacaggacgaguuaccggggcauacgccgacugcgugagagacaucuacucaggcgggaacgccugcaccggauucuugaucuguuggguuuucucccuaaacauuauagcgacucccugaacagguacgggaaguuccugaaugauaucgaguguaagcucccaugggugaaagacgagaccggaucuuauaaguuuauuuuccaagaaucguuuaaagagauguuagccgauuucacagaacaccauccgaagcugaucgcaaacaauaaaaagguacccuacgacuggacuaucuacuaucuucggaagaaagccuugacccagaagauuucaaaagaggagcuggcuuggauacuacucaacuuuaaucagaagcgcggcuacuaucagcugcgaggcgaagaggaagagacaccuaacaaacuuguggaauacuauagccugaaggucgagaaaguggaggauaguggggaaagaaagggaaaggacaccugguacaauguucacuuggagaacgguaugaucuauaggcggacuuccaauauuccacucgauugggaaggcaaaacaaaggaguucaucgugaccacggaccuggaagcagacgggucucccaaaaaggauaaagagggaaacauaaagcguagcuuucgcgccccuaaggacgaugacuggacuuuaauuaaaaagaaaaccgaggcugauaucgacaagaucaaaaugacagucggcgccuacauuuacgauacucugcuccaaaagccagaccagaagaucagagguaaacuugugaggaccauugaacggaaguauuacaaaaacgagcuguaucagauauugaagacacaguccgaguuccacgaagaacuacgagauaaacaacuguacaucgcgugccucaaugagcuguaucccaacaaugagccucgcagaaacucaauuaguaccagggacuuuugucaucuuuucaucgaagauaucauuuucuaccagcggccacuuaagagcaagaaaucuuugauagacaauugcccguaugaggaaaaccgcuacaucgacaaggaguccggggagauuaaacacgcaucaaucaaguguauugccaaaagccauccccucuaccaggaauuuagacuguggcaguucaucguaaauuuaaggauauaucguaaggagacggauguugacgugacucaagaacugcuaccuacagaggcugauuacgucacccucuuugaauggcugaacgagaaaaaggagaucgaccagaaggccuucuuuaaauauccacccuucggauuuaagaaaacuacaaguaauuaccgguggaacuauguggaagauaagccuuacccaugcaaugagacccacgcacagauuaucacgcgacuuggcaaagcucacauucccaaggccuucuugucuaaggaaaaagaggaaacccuguggcauauccucuauuccauagaggacaagcaagagauugaaaaagcgcugcacagcuuugccaacaagaauaaccuuucggaggaguucaucgaacaguuuaaaaauuucccgccuuuuaagaaggaauacggcucuuacuccgcaaaagcuauuaagaaacuguugccccucaugagaauggggaaguauuggucaaucgagaacauagauaacggaacaaggauccgcauuaauaaaaucauugacggugaguacgaugaaaacauccgggagagagugaggcagaaggccauaaaucugacugacauuacccauuuccgcgcuuuaccacuguggcuagccuguuaucucgucuacgaucgacacagugaaguuaaggacaucgugaaauggaagacaccuaaagauaucgaccuguaucuuaagagcuucaaacagcauuccuugcggaaccccauuguagagcaagugaucacugagacccugcguacagucagagacauuuggcaacaggugggccacauagaugaaauccacauugagcucgggagggaaaugaagaauccagcagacaaacgcgcccggaugucucagcagaugaucaagaacgagaauaccaaccugagaauuaaggcuuuacugacugaauuucuuaaucccgaguucggaaucgagaacguuaggccuuacagcccaucacagcaggauuugcuccgaauauaugaagagggcgugcugaauaguauccuagaacugccggaggacauugguaucauucucgggaaauuuaaccagacggauacacugaagcgccccacccgguccgaaauccuuagauacaaauuguggcuggagcaaaaguacaggagcccuuauacuggcgagaugauaccauuaucuaaacucuucacccccgcguacgaaauugagcauaucaucccucagucacguuauuuugacgauagucugagcaauaaggucauuugcgaauccgagauaaacaagcugaaagaccgcucucugggauacgaguucaucaagaaucaccauggcgaaaaaguggaguuggcauuugauaagccaguagaaguucucucgguggaggccuaugaaaaacugguccacgagagcuacucccacaaccggucaaagaugaagaaacuacugauggaggacauucccgaucaguucaucgaaagacagcucaacgacaguagguauauuucuaagguggucaaaagccugcuuuccaauaucgugcgagaggaaaacgagcaagaagcuauaucaaagaauguuaucccguguacagggggaauuaccgaucgguugaaaaaggacugggguaucaacgacguguggaauaagauuguacugccucgcuuuaucagauuaaacgagcucacugagagcacaagguucacgucuauaaauaccaacaauacuaugauuccauccaugccccuggaacuucagaaaggcuuuaacaagaaacggaucgaucaucgacaccaugccauggacgcaaucauuaucgccugcgcuaauagaaacauagucaauuaccugaacaaugugagugccagcaagaacacaaaaauuacccgcagggaucuacagacacuccugugucacaaggacaagacugauaacaaugggaacuacaaauggguuaucgacaagccuugggagaccuucacgcaagauaccuugacagcacugcagaaaauuacugugucuuuuaagcagaauuuacgugucaucaacaaaaccacaaaucauuaucagcacuacgaaaacggaaagaaaauaguguccaaucaaucaaagggcgacaguugggcgauuagaaagagcaugcacaaagagacuguacauggugaagugaaccucagaaugaucaagaccguuucgcugaaugaggcucuuaaaaagccccaggccaucgucgagauggaucugaaaaagaagauuuuggcaaugcucgaacugggguaugacacgaaaaggaucaagaacuacuucgaggaaaauaaagauacauggcaguga

SEQ ID NO: 2903 - RNA, 3741 nt, Artificial Sequence
  Cas9 variant
augagacugguguaccucgcccuugcucacaugaucaaguucaggggccauuuucuguaugagggggacuugaaagcagaaaacaccgauguccaggccuuauucaaggacuuuguugaggaauacgauaaaacaauugaggaaagccaccuguccgagauaacuguggacgcgcuaucuauccucacggagaagguaucaaaaaguagccggcuggaaaaucuuauugcucauuaucccaccgagaagaagaacacacuguucggaaauuugaucgcccucucccugggucugcaagcaaacuuuaaaacuaauuuccagcucucugaagaugccaaguuacaguuuucgaaagacaccuacgaggaggaucuggaaggccuuuugggggaggugggagacgaauaugcugaucuguucgucucagcaaagaaccuauacgacgccauucuccugagcggcauccuuacaguggaugacaauaguaccaaagcuccucuguccgccucuaugguuaagcgcuauaaggagcacaaagaagaguuggcggcauuuaagcgauucauaaaagagaagcucccgaaaaaguacgaagagaucuuuaaagaugacacuaagaacgguuacgccggguaugugggagcugacaagaaacugcguaagagaagcggcaaauuagccacagaagaggaauuuuacaaguaugucaaaggcauucugaauaagguggagggggcagauuacuuucucgacaagaucgauagggaggacuuccuucggaaacagcgcaccuucgauaacggauccauuccacaucaaauccaucugcaggaaaugcacgcuauauugagaaggcagggugagcacuaucccuuucuaaaggaaaaucaggacaaaauugagaagauccugacguuccggauuccuuacuauguaggcccacucgcccgcaaagggucacgauuugcgugggccgaauacaaggcagaugagaagaucacucccuggaacuucgacgauauccuggacaaagagaagagugcugaaaaauuuauuaccagaaugacacuuaaugaucuguacuugccugaggaaaagguucucccaaaacacagcccccuguaugagacuuucaccguguacaacgaguuaacaaaggucaaguaugugaaugaacaaggagaggccaaauuuuucgacaccaacaugaagcaggaaauauuugaccauguguucaaagagaacaggaaggucacgaaagauaagcugcuaaauuaccucaacaaagaauuugaggaguuccggaucguuaaucugacuggccuugacaaggaaaacaaggcuuuuaaugccucuuuggguacauaucacgaucugcguaaaauucucgacaaguccuuccuggaugacaaagugaacgagaagaucauagaagauauuauccagacccuuacucuguucgaggaccgcgaaaugaucagacagagguugcaaaaauacucagauauuuuuacaacccagcagcucaaggagcuggagcggcgacacuauacgggguggggacgcuuaagcuacaagcugaucaauggcauuagaaacaaagaaaauaagaaaaccauacuagacuaccucaucgaugacggcuaugcaaacaggaauuucaugcaacugauuaacgaugacgcccuuaguuuuaaggaggaaaucgcucgggcgcagaucauuggggacguagaugacauagcaaaugugguccaugauuugccuggaucuccagccaucaaaaaggguauucugcaguccgugaagaucguugacgagcucgugaaagucaugggccacaacccgacaaauauuaucauagaaauggcucgcgagaaccagacuaccgauaaggggagaaggaacagccaacagcgucugaaauuacugcaggacucgcuuaagaauuuggauaaccccgugaauaucaaaaacguagagaaucagcaacuccagaacgaccggcuguuccuauacuauauucagaauggaaaggauauguacacaggcgaaacucuggacaucaacaaucucucucaguaugauauugaccauaucauaccucaagccuuuauuaaggauaacucccuggacaaucgaguucuuaccagaucagacaaaaacagggguaagagugaugacgugccaagcaucgaggucgugcacgaaaugaaauccuucuggucuaaguugcugagcgucaaauuaauuacacagcgcaaguuugauaaucucaccaaagcagagcggggcgggcugacugagaacgacaaggccggauucaucaagagacagcuuguggaaacgaggcagauaacaaaacauguugcucaagugcuggaugcccgcuuuaaugcaaagcacgacgagaacaaaaagguaauccgagaugucaaaauuaucaccuugaagucaaaccucgugagucaguuccggaaggacuuuaaauucuacaagguucgugaaauuaaugauuaucaccaugcgcacgacgcuuaccugaacgccgugaucggcacugcacuacugaaaaaguaccccaaacucgccuccgaguuugucuauggggaguucaagaaguacgaugugagaaaauucauagcuaagagcgacaaagaaauuggaaaggccaccgcaaaauauuucuucuacucuaaucugaugaacuuuuucaagaaggagguaaaauuugcugacgguacagugguugaaaggccugauaucgagaccucagaagacggcgagaucgccuggaauaagcagacugauuucaaaauuguccgcaaggugcuuaguuauccacaagugaacaucgucaaaaagacagaaguucagacgcauggguuggaccggggaaagcccagaggccuguuuaaugcgaacccgagcccuaaacccaagccagauuccucugagaauuuaguggguauuaaaaggaaccucgacccuaagaaauacgggggcuaugccggaauaucgaauagcuacgcugugcugguaaaggcaaucauugagaaaggcgucaagaagaaagaaaccauggugcuugaguuccaggggaucuccauucuggaucgaaucacuuuugaaaaggacaaacgcgccuuccuacucggaaaggguuacaaagauauaaagaagaucauugagcugcccaaauauucauuguuugaacugaaggacggcagucggagaauguuagcuucuauccucagcacaaacaauaaacguggggagauucacaagggaaacgagcuguucguuccacagaaauucaccacacuucuguaccacgccaagaggaucaauaaccccauaaacaaggaucauauugaauaugugaaaaagcaccgcgacgauuuuaaagaguugcucaauuacguccuggaguucaacgaaaaguaugugggcgcaacuaaaaauggugagcggcuaaaggaagcgguugccgacuuugacuccaagucaaacgaggaaaucugcaccagcuuccugggggcuguaaauucuaaaaacgccggccuuuuugagcucacgucccugggaagugcaagcgauuucgaauuuuugggcgugaagaucccuagauacagggacuauaccccaucuucccuguuaaaagauucaauucucauacaucaaaguaucacagggcuguacgagacucgaauugaccuuagcaagcugggagaggauuga

SEQ ID NO: 2904 - RNA, 3747 nt, Artificial Sequence
  Cas9 variant
augaagaaaauccugggccucgaccuugggagcgccuccauuggaugggcugugauaaccgagaacgucgaaaaugguaucacaaagugcgauauucugggcauggggucuagaaucauucccuacgagggaacugaaggcaaagacuucacgaaggguaccggggagucaaggaacaguuugcggacaaaagcaaagacugcccgcaagggauaugaucgauaccaguuacguagaaaauaucugguugacacccuaaucaagaaucaaauguacccugaugaagcgacaaggaaccucccaaaaaugaagcugugggagcuucgggacaaagcugugcacagcccgguaucccugauggaguugggccgccuccugcuguggcucaaucagaagagaggcuauaagucuucgaggucagaugccaacuuagggaaaaaggacaccgaauacguggcaacugucaaaagccggcaugagaagaugaaagaacuggaugugacaauaggacaguauuuuuaccgcgagcuuagugccaaugaguucuuuaagguuaaagaaaacaucuucccccgagaggcuuacauugaagaguuugacgcaaucuguaagacccagcaaauugcccacccuaugaucuugagauccgaacugauagauaagauuaggaaugaggugaucuauuaccagcggccacuaaaaucucagaagggucucgucagcgugugcgaguucgaaggcuuuuggcguauugggaaagacggaaaggaguauuucguaggccccaaaguugcuccuaaguccucaccacuguuucagcuugccaagaugugggaaaacaucaauaacaucaaaauugguagucgcacgggggaggaucugaaguugacuaccgaacaaaaaugggcgauauuccagcaucucgacaauaacgagaagcugacacccacugacuuacugaaaauccucaaucuuaagaaggagaacuguuacgugaacaaacagaugggaaagggccugaauggcaacauuaccaaacacgcaaucuugcagugccuagggggaagcgauaaguaugaaaaucugcucaaacuggagcuuaagauggucgacggugauaaggaaggcuaccuguaugacagaaaaacaggggagguguugaacucuaagaugauaaaauuuauugauccuaugguggaacaagagccauucuaccagcucuggcauaucaucuacuccauucacgaccaggaggaauguucaaggguccugcaagccaaguuugauaucgagcagccgauugcugacaaauuagccgcaauagauuucagcaagcacgcuuucggaaguaaaucugccaagguuauccggaagauucugcccuaucuaauggacggcgaugguuacuccgaagcgaugagcuaugccggguacgaccauucuaauucgcagaccaaagaggagaaccuccagcgaaagcugcuugacuugcugaaaccuaucccaaagaacucccuccgccaacccaucguggaaaagauucugaaucagaugguaaauguggucaacgcaauaaucgagaaguauggcaauccugaugaaauuagaguggagcuugcuagggaacugaagcagucaaaagaggagcggaacgacgccgauaaggcuaugaguaaacgccagagagaaaaugacgccaucacgaagagguuggaggaauuuggacuccgugcaacucggaacaauauuaucaaauggcgacuguacgaggaaauagauaaccaagagaagaaguuaaacgccaugugcguuuauuguggccagccaaucagccugacagaggcucuaagagggaaugacguggauauugaacacaucauucccaaauccaaacucuucgacgauucucagagcaacaaaacccuggcgcauaggcacugcaauaagaacaaaaaugaccuuacugcauacgauuuuaugaagggaaagccggaggccgucuucaacgaauacguggagcgcguaaauuugcuguaugacaaccacaucauacggaaagcuaagagagauaaacuccugaugacagaaucaaagauuccugacaauuuuaucgacaggcaguuacgcgagagucaauacauugccaaaaaggcacgagagauccugcagaccauaugucaugauguuugguccacgagcgguaccgugacagccgaacuucggcacuuguggggcugggacgaugucacuaugaaccuccagauggcuaaauaucgugagcuggggcuaacccaucagguggaaugggagucugagcacggaaagaauaagcaugaaaaagaggucaucacagacuggacuaagagagaugaccacaggcaccaugccguggaugcacugaccauugcgugcacaaaacaaggcuucauccagcgcuuuaacacccucucagcugccaagacucgggaagacaugauguucgauauugagcagagaagucacgaauuuaaagagaagaggagccugcuugagaaguacaucauauccgaacaacccuugaaaguugacgagguggaaaaggcaguaucuaauauucugaucucguucaaaagcgguaagaaagucgccgugugggggacgcgaaagaucggcaagcgcggauccaaaaagguuauucagaaaaagaucauugugccacggggcucauuaagugaggaaucugucuaugggaaaauaaagaagcaggaggagaaagauuacaaguaucucuuugaaaacccucagcugaucuucaaucccacaauuaaagcuaagguggaggaaagacuucugauguuugacggagaugugaaaaaggccaucaccagcuugaagaaaauuccaaucuaccucgacaacaacaagacuguaguucuggagaaagcaauaugucuaaaggacgaguucgucaucaaauacuccguggauauuaauuucaacaagguggacaaagucguugaucccaagaucaaggaaauucugcaaaauaggcucaaaaaguuugguggcaaagagaaggaggcuuucaaagacgugcagcuggaagauaagaugaucauaaagugguaugaagacgaggggcuugagcguccuauuaaaucagugcgcugcuuuaccggauugagcgccguagucccagugaagaaagaugaaaacggcaaugacaucgguuucguuaagccggggaacaaucaucacaucgcgauuuacacagauaccgaggaaaacaaacagcagcacgugugcacuuuuuggcaugccgucgagcggaagaaguaugacauacccgugaucauuaaaaauacaaacgaaguuugggauaagauccaaucucagccugacggcacguacccagacuccuuccuggagauguuacccccuccaaaucucaaccugcuugugaauaugcagcagaacgagauguuuauucugggaaccacuacagaagauaucaaacuagcuauagacaagagagauuauaaaaucauuggcgacaagcucuacaggcugcaaaagaugaguaucaaacccagcucugggcagauugauaucguauuccgacaccauuuggagacccagcugauagacgaugaaaauuccaagaaaucaaagcgguuuuauaacguccaaaguuuaggagcacucuucgcccugaacccguuuaaagugcgcauugacaaucuuggcaaccuggugaaggagaaauga

SEQ ID NO: 2905 - RNA, 3762 nt, Artificial Sequence
  Cas9 variant
augaaggccagaggcaacuuccugcaccaggacacccccgggcucacagcugcaaaugccaacaugggagaugcgguggagaaacuuugcgucgcucuggaagacugguguacuuugaggaauuuagagugcaacauccggaagaaucagaaaaacauucaaaaucugcuagaagguaagacgguugaggugagcgccgaaaacgcacucaaagaguccuuugauucuucacgcgccagucgaaaggacaaggcuaccauacugagcacauggaucgcaauucagccuggcgaguaccuugaugccaaacaggcuaaggacgccuccaaagaaaucgcgaauguacuguucggguugcaaggaaacaugaagaaaauuuuuaucgaguucgaagaggaucagaagauacgucucgacaaugaugaacagguggaagcauuuuauucucuguguccagacgauggcgucgcccuguucgagucguuucagucaaucuacagcgcuuauauucucauggguaucuuaaagaacgccaaugggggaaguauuuccucuugcaaaguggcagcuuacgaccaauauaaggaagaucugaaacuuuugaaggaccugguuagagaguucgccagcgaaaaauacgacgaguuuuucaggggcgauaucuuugacuccucaaagggcuuccgggcgcgcaacuauaauccggccacugcaaaaggguacaccaaguacaacagugugagaggagcuagcuaugaugacuuuaagaaagaggucgaaaagauauucaaagguacaguggccgaggaagauauuagguacguagacaugaugcagcgguucgcugagggcaccuuucuacgccgacucaagacuucugauaacggguccauccccuaucagcugcaucuugaagagauggacgccauuguugagaaucagaaacaauucuacccuuuucuggaaucagagaaggaaaaguuggagagccucgugacauucagaaucaguuauuacgucggaccacugacccagaaaaacgcaagguuagauaaucacaacaaugcccgguuugcuuggucucagcguaaggaaggcaaagagcaugcgcgcguguaucccuggaacugggaggaagugaucgacagaaagcaauccgcagccaaauucauggagaggcugacggguacuuguaccuacauucucgaugaaccuguccuuccacggugcagccuguuguacgaggaguauugucuacugaaugaacucaacgggucgaaguggcgagacaugggaggcgacuggcaccgcuuugauuacgagacaagaauggaaauaaucgagaaucuguucaagaaaaagaaaggcucuguuaaguaugcugccguggaagacuggcuuaaaugcgagaagcauaaguccugugcagagguaaaagggggacagggugaaacuggcuuugagucaaagcugaguagcuacguguucuuuaaagaagucuugcacguggaugagauugacgaagccgauauccccaugauagaggagcucauuugguggaacacccuguucgaagacagguccaucuuaaaggagucuaucgaagauaaauauggggaccggcugacagaugaccagauuaaggcuaucugcaaaaagcgcuuuaccggauggggcagacuaagcaaggagcuccugugugguauuaaaacgcacacugauaaugggccuuacucaauaauggacguucuuagggaaggcaacccaaauaacaaugcccguagugagacaaugguguucauggagaucuugcgggaugacaaguucggauuugacaaacugauugaagaggaaaacaugcgaagagucuccgagguggauaacuucgacguaaaugaucucccgggcagccccgcaguuaggcgcaccgugaaccaggcgaagcggaucgucgacgagaucguggggauugcuggaugcgaaccucaaaauauauuuaucgaggucacuagagaugaagacgguaggaacaaaggccgccgaacaaagcggcguuaugauaauauuaagaacgccaucgcagcccugaaaaaggagcagaaagaauacuucaauaaggacgugucugauucacuuaacaaaaccaauccaagugaccuggauaacgagagauuggcucucuacuuuaugcagaaugggaagugcauguauuguggaaaggaccuggauauuaaacaguuagacaaguaccaaguugaccauauccugccccagagcuaugugaaagaugacuccuucgagaacaaggcccuaguacacauggaagauaaucagaggaaaucugcaucgaugcuccuggacgauagcauaauccgcaagaugaagccuuacugggaggcccuucgggcugcgggcuugauuggugagaaaaaguuuaaaaaccugacgagagucaggguguccgacaaggagcucgggggcuucaucgcccgacagaugguugaaaccucacaaaguaugaaacugacaucuuuagugcuggagaagacuuauccaaauaccaacguccgccccgugaaagcuggauuuagcuccgaucuucggaagagauuggaccucauuaagugcagggagaucaacgauuaccaucacgcacacgacgccuaucuggcuugugaaauaggccaguucauuacaaugcgucauaauaaacuauacgagaacccgaucucauacagccacgccguaaaggauuuuauugcaaaacgcgcgaaguaugccaaugaccaugggacuccuaugucuaccuacggaaugcccgguuccaguagcuucgugaucucuuccuuucugacaucaggcuucgacgaagagaccggggaaauauucaaagaugcuuggagugccgagguugcagcuguccggaucagagagagccucaacaggaaggacugcuauauuucgcgaaugccagaagagacuuccggagccuuuuggaaggaaacgcugaucucuccucgggaucccagccuuggcaaaaauuugucacugccaauuaagaaagguuuagacccccgcaaguacgggggcuauaacgagcagaaauucgcauacuuuuucguguaugaggccgugaagaucaagaaaaagggagaagucaaagaguacguuuuugcugcggugccugugcagguagccgcaauagucgcuagagauccaaaugcccucacaggcuucgccaagaaagacgcugaagcaaggaagauuaaguuucugcggaucauccgagagaaaguguacaaguaucaacuuauugaaguuaacggggagagacuguacaucaccggauugaaaagugugcgcaaugccaggcagauugcgcucucccaggauaugacuaccgucuuccugaaggcuauaaacgacaaagauguggccgaggacgaacuaaagucucuguuugaggaaaucguucaacguuaucggcucugugcaaauagacugggcaaccagcuuaagauuuucagcuuguccgauucauuuaauagcgccaacagugagucuaaaaagagggcucugguguccuuaguagcaaucauugacgccaaaacaaauaagaucgaucucagcgguauagggucgggaaaagcggucggcaacaugcgccugucauucucuaaggaaaugaguaacuccaaaaaucacuucgcuuuuaucgaccagagcgugaccgguauguucgagcgaaagacuuaccuuuga

SEQ ID NO: 2906 - RNA, 3777 nt, Artificial Sequence
  Cas9 variant
augaccgaggaaaaccccgacaucagaaagguguuccuggccauucaccauauacucaaaaauaggggccacuuucuucugcaggggcaaucauucaaggagggaaacuugaauaacuuaaucaaagaacugcuaaaucucgauauucugcauaucuccauugagaucacagaagagaacauaaauaagaucacugagauugcucuugagaaaaagacgcugaccgacaaggucaacgauuugaaaaagaucuacccuaaagagaagcagcuccuggaagcauuucggcugauuuucgguggcaaaacaucucucgacaaguuauuugccaucgaugaguauaaggagcuggacgcgucaguuaaaagugugagcuucaaggagaaaauauacgaagaaguacgccacgauuaugaacaggugcuuuccaauuacauugaauugcuggaccuagcuaagcucgucuaugauucuaucauucugucggacaucaaaaaggaggggaaaacucuuucagagagcaagguggaacuguaccauaagcaccgagaggauuugaccaaacucaagacacugguuaaaaacgacaguaaguuauccgaagauaaaaagguggagcuguauucugccaucuuuaaggaagacaaagacaagggaaccaauuacgucaacuacauucguaaaagcgaggagggcaaggguugcaauuaugaagauuucaaaaaguuucucgugaaggagcuugcaaaacuggaagaguccucagccaaggaagagauauugagagaccuagagcuggaacucuuccugccacuucagaggacuaaagauaacaguguaguuccguaccaaauccacaaggaggaacuggugaaaauuuuggacaaugcugcaaaguaucauaaguuucucaacgagaaagaugacagcggguacucuaucauagagaaggucauucagcuguuagaauuucggauccccuauuacgugggaccucugaacuccagcaaaaaggccaaaguggauggcuuugcuuggagcguccgcaauaagggcuaugagaacacaccaguuacccccuggaauuacgaaaaagugaucgacgagagugccucugcggaaaaguucauuacgaaccuaacuaauaaguguaccuaccucaaaggggaggauguacugccuaaguccagccuuuuguauucggaguucgcacugcucaacgaacugaaugcccuuaaauacgacggaaacagaaucucucuggaggcuaggaaugugauuauagaaaaguuguuuaaagagcaggguaagaaggucacaaaaacuuccaucaagaaccuccugaaagccgaaggcuauauugaugggaagggagagaucaccggcaucgacauuacagugaaaaaugacuuaaagucauaccgggauuucaagaaaauacugggugacaaguuuaacaccgagcacguugaaaauaucauucuauggaucacgcucuauggggagagucgcaaacugauuaaggcaaaaaucgaagcuguguacggagauauauauagcaaggaggaaaucgccaagaugucccgacuugucuacaaagacuggggcagauucucuaggaaguugcugacugagcucgugagcaaaaagcuguacaacgaggaaacaggcgagugcuuaaauauuaucggggcgaugcggcagaacaacauucuguuuauggaacuuuuggccgaucguuucgacuauucacaacagaucauagauuacaauaaagagcuccagaaggagguaaccgaaauuacuccagagauccuggacgaucuauauguuagucccuccgugaaacgcagcauuuggcagacagucagaaucguggaggaacugaagaagauaaucggaugugcuccugcaaaaauuuuugucgaaaccacgaggucuaaccaagacaagaaaaagccaaccgauucacggaaaaagcagcucgagcuguucuacaaggccgugaaaaaggacguuaaagaucuugagaaggaaaucgguaguuugaauuuugacaaacugaacgagcgauuaagcuccguggaaccgucuaagcucaaggcuaaaaagcuguaucuuuacuauacacagcugggccgcugcauguacucgggggagacuauugacaucacccaauugaauacaacugccuacgauauagaccauauuuauccccagagcaaaguaaaggaugacuccuucaccaacacaguccucgugaaaagagaauacaaugcagccaagaccgauagguauccucugggaucagacauccagacuccaaguaaccggcgcuuuuggaaguuccuaaaagagaagggccugaucacggaugagaaauacaauagacucguuaggacagaagaguuuucugacgaggaacugaccgguuucauugcucgucagcuuguggaaacuagccaauccgucaaggcgguggcagggaucuugggcgagcugaaccccaaaaccucaauuuguuauagcaaggccgagaauguaucuuccuuccggcagaacuuuggaaagauaaaagaaggcaaucgaaagagugauaacacagagcaguuaaucaaagugagagaaauuaaugacuaccaccacgcuaaggaugccuaucucaacguugucguggggaacguguacgacaccaaauucacuaggaaugucuuuaacuucaucaaggauaaaaaggacggacgcaaguacagccugaauaacguuuucuaugagaaugugucuaacuccaauaacguggcaugggagcuuaauaaaacaguacaucaggucgaaaaggugaugaacaauaacaauauucugguuacgcggagaaccucagagcaaaaagguggccuauucgacgccacuguguacaaggcuaaagucgccgcaaaggcgaaggaagggguguauuacccucucaaaacaagugauccaguugugaacgacguaaccaaguauggaggcuuuacaaaagucaagaucgcuuacuauagcauauucgaguacacucuggugaauaaaaagggugaagagaagaucaccaggauuauccccauuccgaucuacgugucgcagaacauaaaagaugacuccacguugcuggaguuugggaagacccagauuaacaucaaaucuggcgaagaggucaaggauuucaaauuaaaguaucgcaagcucugcaucggagaccugguuaaaauuaauaacuuuuucaauuuuauaggcgggaagacaaacgauagcuucguguacgacggagccguacaggugacucuugauaccgaaucagagcgauauaucaaaacacugaguaaguaccaaaauuggaaaaaggaaaacaaagacggugaguugugggaguccauuacuaaggaaaagaauaccgagcucuauaaccugcuagucgagaaaaugaacucuggcaucuucauuaagaaaaagccuaauaaauuuaaugaacugaacagcgaagagauccggaauaacuucuccucaauaagccuugaggaacaggcaaaggugcuccuggagguuuugaaucuguuaacgaacaagaaaaguaucuuugaucucaagucuauuaauaucacagccgcucgugggaaaauuuccuucaaccugagcaaccuuucgcaguuuucaaucauagaacagucuguggccggauucuacgagaaggagauuaccaucaucggcgacaaagaaaaugacauggagaacaauaacuguuga

SEQ ID NO: 2907 - RNA, 3780 nt, Artificial Sequence
  Cas9 variant
augaaguacauccugggccucgaccuugggguggccagcauuggaugggcugucaccgagauaaacgaaaaaggugagcccguuggccugaucgaugcaaauuccgugauuuucaagccuuuggacaacgauaaagggaaguuauauaauguagaaagaagggacaaacggggaucucgccgaauccugcguagaaagaagcacaggguggagcggacaaaaaugcuacucgucaacucaaguuuucugacuaaugaagagauugauaaccuuuacgugggcaagcuggacaauaucuaugagguucgcuugaaaggucucaaggaacagcugagcaaaaacgagauagccagacugaugaucuacuauugcaagaauaggggguucaaguccaaccggaaaacggaagaucucgagauuuuaaagucucugggagagaaaaucucggaaaaggacucagaugagaaaaagcugaaaccaauuaucgcgaagaauaccgaauugauagagagcaagggccugacaccgauugaagugaucuacaugauucgcgagaacgacaauaguauccuaggcuuuaaaaacaaggaggggaauuauaaauucggauuuaagcgaaaccaagucaucgaugaagugagaaaaauucucgguacucagcagauacuguccaaggagaucguagacgaauacauugauauccuuucuagccagagggacuucuccgacggccccgggggagauucaaaguacaaaauagacuauaccaagcuggcuggcaaauguaaguacacaggugagguucgggccgugaaaagugcaccuagcuaugaaauuuuuaccauguugcaaaagcucaacgauauccguuacgucaaguucacuucugaggacaaaaucgagaagaaaaagcuguccaaagaagugauucauaaguuauaugaucugguggucgagaagaauaaaacacucaccuacgaccuuaucgaaaagucaauugaugaggaaaacauaaaacuguugaauaucccaaagcuaagcaaaaguaaguauguugagcugcgcaaaucuuacuuuaaggagagaaacgacaaugaaaaccucacggaggaagagauuaaugccuucaacgagaagcugaauaacgaaaggaugaaacaggagcuuauccggaauaaccugaaggcuuacaaagaauugaaguccaaauuuaagaagaauaacaucgaugagaaucgaauuaaagaacucgggggaauauauuuccuggacuuaguggcagagcugcuaacuuacagcaagaccgaugagaaacucgaauauuuuguagagaacguggaacgcuacucgcuguucaaggagcagagagacaucgucgaaauuaucaaaacauuccccaacuauacuaagaauggcaaccuuucuuugucccuggugagggagcucaauaagcugcuuauggagggccacgacuacgaaucaagucugagcuccuugaacuauuacauugauaccgacguugauugggagaaauuuccuacaaucucugaaauagaggacagccucucaaccaagaucacgaauccaaacgugaaacauauucuggucaucuuacggaagcuguacaauacucuacucuucaaauaugggcgccccgaaaaggugcaccuggagcuuaguagagauuuuuccaacgacuucagcacaaggaauaagauucagaaagagcaauuggaaaacaagguacgucgggagguugccgcuuuugaaauguacggagccaauaaagauaucguggcggguaaggaccgacugucuaacgaugacuucgucagaauaaaacucugggaggagcagaauaaggugugcauguauucaggcaggaccauugaaaaauaccagcugacaagugcagagguccagaucgaucauauuuuaccuuauagcaaguccuuugacaacucuuacucgaauaaggugcugguuuucagcaacgaaaaccaagauaaaaaggagcgcacuccauaucaguggcuuaaagggaccgaaaaguggaaugaguuuaaacagcgggugagauugaaccucaauaucuccaacaagaagaaagagaaucugcuauucgaagacgagguagucaacaaugaauuucuggagagggaacuccacgccacgucauacaguucucgccuggcucuuaacauauuccaacgauugaucccggugagcgacgaggauaaguacgacgagcacggaaaugaaaaaguuaaguaucuguacaaccggaaugugauugccuuucagggcaaaaugaccuccauguuacguaaccucuauucacugaauaaguacacacauagcuucgagucugauacucuugacaucgauaacaaggcauucauucugaaagaauuugagaucaauaaggacaacuugaaaaugaccgcuuauaacgucaauacaggucucgaaauaacuuccgagaccaagguggagaaaaacaagaguggggaguucaagacaauuaaagaugaacugcuaaagaaagaacuggacaagaaagagaaucucaucgagaucagcgauuacuuuaaggacaagguacuguucgaucuuaaaauuguggacuuugaagagaucgauaccguugaacccgagauuauaucuaucuuguauaagaugauuacugcccugaaagaagaggucuacuccaagaacagagagaaucacuuacaucacucacucgacgcguuccugcuuacgaucaugaacaggaguaugcagaugaaacugauuaaguacaaucagcuaaucagcgugcucaaaaacaaggaaauagagaucuuuaaugaagagaagggcgaauauauugacucgaaagaguucgccgaggaacugcaaaagcagaaaaucauugauaucgacggaaacgagcgcggcauaaaguuuaaugugaacgggaaaacacaccgguugaaucuggucaagccuuacgaaaacuucuuagaugacauuaagaauaaaaucuuugauaagagagagaacaauaaacucccauaucauguugugaaguccaaagugucuggagcacugcacgcugaaaccauccuuggugagagcaagggcgagauuacuaagaggauaucaguauucgacaucaacuacaaaaaccuggggaagauuuuugauaaagacggaagucagaaggaaaucuaugagaccuuggucaaauggcucgaagccaaguccaaggauuaccccaaacugaagaauggcaacauuaucaaaaaggugaaaauaguugacgguaauaaggauaaacuaaucaagcuggggaacaagcgauauguggagaugggccgcacaaccgucaaaauucuugugcucaagaaagaggcugaagagggacugaaguucgccucuaucggccgguacaaauacaauuugcuuaagagcgaaaaggacguuaacauuuccaucuggaaagacgcaauacauuucuguaaggugagauauaauaaauuaaaggagaacggguacaggcucauucacgaacugaucccuggagagacuaucgagcuugaacugaauaaagguaacauuucaaagugcuugguagucggcuuuagcgggggaaagaucgagauaaguucugugauuggcgaugcccucgaccugaucaaugauaaaauuuccacacguaucaaggaacgcuauuacauaacggugagcaccauuaaaucgaucaagaaaaucaacaagaauauucuaggugacuga

SEQ ID NO: 2908 - RNA, 3792 nt, Artificial Sequence
  Cas9 variant
augcacaagaacaaucccgacaucagagagcuguuccucgccauucaucacauacuuaaauacaggggccauuuucuguucgcugggcagcaauuuaagggaagcgaaaucaaagauaacauucgggaguuguuacaguauaauucccugaacaucaagauugacaucaccgaugaacuaauaaauaacaucgcagagauucuccugaaaaagaaaaauucuacagacaaaaucauugaguucaagaaacuuuuugccgaugagaagcagcugaucgaggcguugcgccucgcucuggguaacaaaacucagcuggccaaacucuucgacauagaagcauacaaggaguuagauauuucaaucaaaacgauuaguuuuaaggagaaaaucuaugaggacgugcgaagcaauuacgaggaaauccugggcgaguauauuauaguccuugauaccgccaaguugaucuacgacgcuauuauccuguccgaaauaaaaauuaagaacaugacaaucucugagucgaaaguuaucucauaugaaaagcacgggaaggaucuaaaacaacucaagcagcugauuaaagaggacagcaaacuuaguaaaaaggagaagcgucagcuguucgaaaauaucuuugugaaagaggaugaaaaggaggcaaacuacguaaauuacauuggaaagaacaaugugggcuccucuaagagcuccugcucauaugaagacuucaaaaagaguuugauaaaggagcucaaauacugugaggaaagcaagcugaaacaggacaucuuagccgagcuggaacucgagacuuuucuuccuagacaaaggaccaaggauaacucugucauuccauaucagauccauaaagaagaacuggagaagaucuugaacaaugcugugcaguaccacccguuccuaaacaauacagacgaauaugguauuuccauaaaggagaaaaucauucagcugcucgaauuucggauccccuacuauguugggucacugaacaccagccacaaggugggaaauggcggcuucaguuggucuguccgcaacaaaggguacgagagaacugccgugacaccuuggaauuucaacaagguaauuaauaaagaggaauccgcgaagaacuuuaucgagaaucuuaccaaccaaugcacguaccuguuguaugaagauguucucccaaaacauagccuguuauacucggaguucacucugcuaaaugaacucaacucuauaaauuauggagguaagaggcugaccguggagcaccggaaccuuaucauugagcgcuuuuucaagcaguccgcacccaaagccacaggcaaggaauugaaaaaguuucugaugucagagggggucaucgacggaaaagaugaacucaguggcuucgacauuagcaucaagaacgaucugaaguccuaccgagacuuuaaaaagauacuuggugagaaauucgauucugaaaagguggagaaaaugauuagauggaucacucuguuuggggagagcaagcaguugcucguggacaagauuaccaaagaauauggagauaucuacucaagugaggaaauaaagaaaaucuccggccugacauauaaggacuggggcagguuaagcgagaaacugcuaaccgaaauugucucuucacaacucuacgacgagaguacgggggaguguuucaauaucauuaacgcuaugcggaauaacacucugcuuuuuaucgaauugcugggaacaaauuacgauuauuucgagaagauaaacaccuacaaugguaagcuccguaaagaaauuacugagaucacaccucauauccuggacgauuuauauguuagcccagccgugaagcgcuccauuuggcagguagugagaaucgucgaggaacugaaaaaggugauuggcucugagcccaaaaggauauuuguugaaaccacgcggucgaacaaggagaaaaagggggacgauggacgaaaggacagccgcaaaaaggcacuuuuggaacucuacaaaaagaucaaaaccuccgauauugcugagcuggagaaggcccuaggccacacaguggacuucgauaagaaaaagcaggaccugacugauaucgacaauaacaaacucaaggcgagaaaacuguaucuuuacuauacccaguuggguaggugccuguacacagggaaggccauugauuuaaauaaccucuucggcucaaauagugaauacgacaucgaccacauauauccucaaucuaagacuaaagauggaagcuggaacaaucugguccuugugaacaagaccgagaacuccaaaaagucaaauggccugaucagcgaaucuauucagcggaaaaacaagcauuuuuggcgcuucuugaaggcuaaaaaucucaucuccgaggaaaaguacaaaagacugacaaggaccgaggacuuuacugauggggagcuaaguggauucauugcacgucagcugaucgaaacgagccagucuguaaagguuguguccaaaauacuccaaaaccugaauccaacaaccgagcuuuguuuuucaaaggccgaaaacgucagugacuuccggcaggaguuugguaagauuaaagugggcaagcgaaagaauuugacugaagaggagcagaagaaagcuaaggaagggcagcugaucaaagucagagauuuaaacgaccuccaccaugccaaggaugcauaucugaauaucgugguuggaaacguguaccacauuaaguucaccaggaauccgaaaaacuuuauacgcaagaauuucaaaaaccgggaguauacacuuaauacccuguuuuacagcgacaagguagaaagaaacggcgaggucgccugggagaaagguaagacugaagagaucgugucguccguuaugugcaacaaucuaauuaacgugacaaggcgcacgucugaacaaaagggggcucucuaugaggcgaccaucuacaaagcaaaugccgcuaaggaaggcagcuacuaucccgucaaaacuaacaauaagaaccugaaaaaugugacacgauacggaggcuucaccucaauuaagaucgccuauuacaguauauuuaaguaugauauccggaacaaagacaagguaaaagagaauauuaagaucauuccuaucccaauauacauuucccagaacaucaaaacagauuuggaccugaucaauuucgcagagaagcagauuaaguuaaagaagggggaaaacaucgagaaucuccagcugauauauaaaaagcugaacauuggagcccuugugaaaaucgaucauuaccccuacuauauugguggcaagacugacgacaauuucuacguugauggggcuguccaaguguugcucucuagcgacaucgaacguuaucugaaagagguggucaaguuuguuaacuuccagagagaaaauaaggaggccaaaguguccaaggagcacauaucacuagaagagaacauuaaacuguacaacacccuuguguguaagauggcaacgaaaaucuuuacccacaagaagaauaacaaauauaaugaucucacacaggacaaggcgaaaaacacuuucaauaagcugagcuuggaagaacaaugcaaaguacuguuagaaauccucaaccugcuuaccaauaagaagacaacuuuugaucugaguuugauuaacgagaaaaccucuagggucaaguguggauucaaucuccugaaccagaaacaguuuuccaucauugagcagagcgugacgggccuauacgaaaaggagauaaaaaucauugaagacuga

SEQ ID NO: 2909 - RNA, 3795 nt, Artificial Sequence
  Cas9 variant
augaagaacgugcugggccucgaccuugggaccaauagcaucggaugggcccugauugaggucgaugaaaacaauuugcccauaagaaucauugcuauggguuccaggaucauuccuuuaucuacaucagacaaagaggaguuccagcggggccugaguaucacuaagaaccaaagccgcacgguuucccgaacccagcguaaaggguacgauagaaagcagcuaaagaagucugaccucaagaaaauacugaauaaguauaacaucuuuccaucggaggaacuucugagguugccgaugcucgaucuguggaaacugcggucagacagcgcaaaucccgaugagaacauuagugccgagcagcucggacgcaucuuauacaugcugaaucaaaagagaggcuauaaauccgcgaggucugaagcuaacgccgacaagaaggauagcgacuacgugcaggcaguaaaaggucgguaugaucagcuuaaggaccgcaaacagacaauugggcaauacuucuaugaugaguuguacaaugccaacgcuaauaacuccuacuuucgaaucaaggaagagguguauccuagagaggcauacauagaagaguucgacacuauuaucucagcccagagggaaaaacacgacuuucugaccgaugaggucgugcaucagcuacggaaugaaauuaucuauuuccagcguaagcucaaaagucaaaagggacugguuagcaucugcgaguuugagggcuucgaaaagacaguguuugacaaagagaagaacaaaaacaaggucguguucguaggcccaaaaguugcucccaagaccucuccucuuuuucagcugugucgcauuugggaaguggucaauacuauaacauugaagaucaaaaacccagagggguccaaguacaaauggggagaaaagauucccgauaucaaagagaaggagauacucgccgacuaucuguucaagaaugaaucacuuagcuuuaguaaacugcucgagauucuugaacugaagaaagagaacguguacgugaauaagcagaucuugaaagguaucaagggcaacgaaaccuauucugcgcuacacuccauucugggggauaaugagcuccugaacuucgacgucagcaucaugacgucgaaucaaacugcacuucugguugauagaaagaccggagagauuuuggaagagagggccggccucgaacuggacgcuucuuuagagaaagagccucuguaccagcuauggcauacaauauacucccucaaggaucuggacgaaugcaaaaacgcccuuaucaagcgguucgauuuugacgacgagacugcagaaaaauugucacgaauugauuucaauaagcaggcuuuugguaacaaaaguaauaagagcaugcgcaagauccugccauuccucauggagggguaugacuacucccagucuagcucacuggccggauauaaccacaguaauucccuuaccaaaaacgaaagagagcaacagaucacacuggauagguuggagcuccugccgaagaacagcuuacggcagcccauuguggagaaaauacugaaucagaugaucaacguagugaaugcgauucuagacgaauacggcaagccuucugaaauccgcgucgagcucgccagagaacugaaacaaucaaaggaugagaggaacgagaccgaccuucagaauaguaagaacaaaaaguugaaugaugaaauuggcaaacgucuggaggaacucgggcugccagugacgaagcgguauauccagaaauacaaguuuauauuccccagcuuauccaagaaccugaaagaggcaaagguuaauaaccaguguaucuauugcggagaaacuuuuaaucuuacagaggcuuugucuggugacgccuacgauguggaccauauugucccuaaagcucuccuguucgaugacucgcaaaccaacaaggugcuaguacaccgaaaauguaauagcacuaagacaaaccagaccgccuacgauuauaucgcaacgaagggcgacgagcaccugaaacucuacuccgaaagacuggacgauugguuugagagggggauuaucucauauaguaagaugcagcgccuuaaaguuucucauaaggaauacuuggagcggaaaaagcugggaaaagagaccgaaacagacaagaaguuaugggagaauuucauagauagacagcucagggacacucaauauauuagccgcaaaucccgagaaauccugcagaagauuugcaacgaugugaaaaccacagagggcggugucacugccaaacuucggaaccugugggggugggacgauguguugaugaaucuccagaugccaaaauacaaggaacugggccaaaccaucacaaaggaguggaccucagagcacggaaaacguaagcaucagaaagaagagauagacaacuggacuaagagagaugaccacaggcaccaugcuaucgaugcgcuagucauugcauguacgaaacagggcuuuauccagcgcauuaauacacugaacagcucugacaccaaggaucucaugaucaaggaaguggaggaagccaaaauagaguucaaugagaagacuacccugcuugaaaaauauuugaagacacaaaaacccuuuuccacccaggagguuaugaaggaagcugacaagauucuggugaguuucaaagccgggaagaaaguagcaacuaucacaaaguucaaagccacgggaaagaacaaggagaccggugucaucgugccgcggggcgcuuuacacgaacagagcguuuacgggaaaauuaaggugaucgagaaagacaagccucucaaauaccugcuugaaaauucugauaagauugucaaccccagaaucaaaaaucugauagaaauuaagcuauccgagaacaagaaugacccuaaaaaggcccuccuggcauugaaaaagaucccaauuuuucuggaugaggaacagucaaucacuuuagagaaagcgaguugcuauaacgacgcuacagugcucaaguacaagcugcaaaaucuuaaagccgcacagguagaugacauaguggaugaaaagguuaaaaagaucgucagggagcgacugagccaguucggaaacaaagaaaaggaggccuuuaaggacaccuugugguucaaugaagagaaaaagauucccaucauuacagugcgccucuuugcucggccagaugccaacaaccugcagacuaucaaaaaggacgagaauggcaacgguauaggguucguggucaccggcaauaaccaucacauugcaaucuaugaagauaaagacaauaagcccguucaacauucguguacguuuuggcacgcuguggagagaaagaaauacaacaucccugccgugauuagggacuccucugaaguauggaaugaucuacugcguaaggagcuuccagagagcuuccucaacaaacugccggcggacaauuugaaccugaaguuuucaaugcagcagaaugaaauguucauauuaggacucagucaagaugaguuugucaaagccaucgcuaacaaugacaagucccugcuuucuaaacaccuguauuugguguggagcauuuccgaaaacaauuacugguuccgccaucaccucgagaccaagaacucagaucugaagaaaacagacggcguuaaggaaagcaaacggcuauauaauaucagaagucuggggucuuuauuuucccucaaccccauuaaggugaggcugaacuacuugggagagaucacuaaaauaggugaauga

SEQ ID NO: 2910 - RNA, 3801 nt, Artificial Sequence
  Cas9 variant
auggccaaguacauccugggccucgaccuugggaccaacagcauuggaugggcucugauagagguggaugaaaauaacauccccauuagaaucauugucauggguuccaggaucauaccuuugucuucaaaugaccgggaggaguuccagcgcggcuuaaguaucacuaaaaaccaaaaucgaacaauuagccguacgcagagaaagggguaugauaggaaacagcugaagcggaacgaccuaaauaaaguucucaacaaguacaauaucuuuccauccaagaugcugcuuaaccugccgauguuggaucucuggaaacugcgcucugacucggcaaauucaaacaaggauauuagcgccgaacagcugggaagaauccucuauauguuaaaucagaaaaggggcuacaagagugugcgguccgaagcgaacucugacaaaaaggauaccgacuauguacaggcugugaagggucgcuacgcccagcugaaagaucgaaaucagacaauagggcaauauuucuacgaggagcuuuacaacgcaaacgucaauaacagcuauuuuaagauuaaagaagagguguaccccagagaagccuauaucgaggaguucgacacuauuaucaauucccagaagaccaaacacgaauuuuugacagaucaguucguucaucagcugaggaacgagaucauuuacuuucaacggaagcuaaaaucacagaagggacucauaaguaucugcgaguucgaaggcuuugaaaagaccguguucgacaaagagaagaauaaacacaagauugucuuugugggcccuaaaguagcuccacguagcgcaccccuguuccagcuuugucgcguuugggaggugaucaacacuauaucuauuaaggucaagaauccugaaggguccaaauauaaguggggagagagaaucccaucaaucaaagaaaaggagauucuggccgacuacuuguuuaaaaacgaagugcucagcuucacaaagcuguuagagauccugggucucaauaagaacgauguguaugucaauaaacaaauucuuaagggcauaaaagggaacgagaccuacgcuacgcuguacaauaucuugggagaaaacgaguuccuaaauuuugacguuaguauuauccccucuaaccauacuuccaugcugguggauaagaaaaccggcgaaauccucgaggaaagggccggucuggagcuugacguaagccuggagaagcagccuuucuaucaguuguggcacacaauuuacucgcucaaggaucuggacgaaugcaaaaacgcguuaauaaagcgguuugauuucgacgaugagacugcagaaaaucugucucgaaucgacuuuaacaaacaggccuucgggaauaaguccaacaaaucaaugcgcaagauucuaccauuucucauggagggauaugauuacagucaaagcuguucccuggcuggcuauaaucauucuaacagccuuaccaaagacgagagagaacaacaggugacauuggacaggcuggagcuccugccgaaaaauucacuucggcagcccaucgucgaaaagauucugaaccaaaugaucaauuuggugaacgccauacucgaucaguacggcgagcugagugaaauccgcguugaguuagcaagagagcugaaacaguccaaggacgaaaggaaugaugcugaccuacagaacaccaaaaauaagaaacucaacgaugagauugggaagcgucuggccgaacuuggauugccuaucacgaagcgguauauucaaaaauacaaguucaucuuuccaagccugucuaaaaaucucaaggacgcgcacgugaacaaccagugcauauacuguggugagacuuucaaucugucagaagccuuaaguggcgaugcauaugacgucgaucacauugugcccaaagcucugcuuuuugacgauagccagacaaacaagguauugguucaucgaaagugcaauuccaccaaaacuaaccagacagccuacgacuauaucucuaccaagggggaugagcaagugagaauuuacuucgagagggucgacgacugguuuaaaucgggaaucauaagcuauuccaagaugcagcgccucaaagugucacacaaggaauaccuggagcggaagaaaaucggcaaggaaacggagaccgauaaaaagcuaugggaaaauuucauugacagacagcugagggauacacaauauaucagucgcaaaucucgagagauucuccagaaggucuguaacaaugugacuaccacagagggugggguuacugcuaaacugcggaaccuuuggggcugggacgauguguugaugaaucugcagaugccuaaguaccgugaauuaggacagaccguaaucaaggaguggacaagcgaacauggcaaaagaaagcaccaaaaagaggaggucgaaaacuggaccaagagggacgaucaccgccaucacgccauagacgcacucgugauugccugcacuaaacagggguucauccagcggaucaauacgcugaacuccucagauacaaaggaccuuaugcugaaggagguugaagaggcuaaagugaaguuuagcgagaaaaccacuuugcucgaaaaguaccugagaacccaggagccauucucuacacaagaagucaugagggaggcggauaaagugcuaguauccuuuaaggcaggaaagaaaguggccaccauuacuaaguucaaagcuaucgguaagaauaaagacaguggcguuauugucccccgaggggcccugcaugaacagagcguguauggaaagauaaaggugaucgagaaagauaagccgcucaaauaccuguuugaaaacucugaccgcauugucgacccuaagguuaaaaaguugguggaggugcgguuguccgagaaugaaaacaacucaaagacagcaaucaguacgcugaaaaaggcccccauuuucuuaaaugaggagaaaaccgaaguacucgaaaaggcuagcuguuauaacgaugccacuguccugaaauacaaacuucagucgaucaaagcaucccaggcggacgauauaguggacgagagaguuaaguuucuggugaaggagaggcuagcucaauucggcaauaaagaaaaggaggccuuuaaagauauccucugguucaacgaagagaagcagauuccaaucauuucuguccgucuguuugcacgcccugacgccaauaaccuucaggugaucaaaaaggaugagaaugguaagagcauaggguucguucugacaggcaacaaucaccauauugcuaucuaugaagacaaagauaacaaguuaauccaacacucaugcaccuuuuggcacgccguggagcggaaaaaguacaauauucccguagucaucaaaaacaguuccgacguguggucucagcuccuggauaagcagcuuccagaaagccuguugaauaagcuccccacagacaaacugaaccuaaaguucuccaugcagcaaaaugagauguucauacugggacuuucacagaaagaauuugacgaggcaauuaagaacaaucauaagagcuuccucaguaaguaucuguacuugguguggucuaucuccaacaacgauuacuauuuuagacaccaucuggagacuaagaauaccgaauuaaagaacauuagcacggcuaaggagucgaaaagguacuuccgauuuaagucagucggcgcccucguugggaccaauccuaucaaaauacggcugaaccaccuuggagaaaucaauaaggugggugaguauuga

SEQ ID NO: 2911 - RNA, 3807 nt, Artificial Sequence
  Cas9 variant
augaccaagaacauccugggccucgaccuugggacaaauagcauuggaugggcccugauagagguggaugaaaacaauacucccaucagaauuaucgcuauggguuccaggauuaucccuuugucuacgucagacaaagaggaguuccagcggggcuuaaguauaaccaagaaccaaagccgcacagucucccgaacucagcguaaaggguacgauagaaagcagcugaaaaagucugaccuaaagaaaauccucaauaaguauaacauuuuuccaucggaggaacugcuuaaacugccgauguuggaucucuggaagcugaggucagacagcgcaaaucccaacgagaauaucagugccgagcagcugggacggauucucuacauguuaaaccaaaaacgcggcuauaaguccgcgagaucugaagcuaaugccgauaagaaagacaccgauuacguucaggcagugaaggguagguaugcccagcugaaagagcggaaccagacaaucgggcaauacuucuaugaggaacuuuacaaugcuaacaccaauaacagcuacuuucgcauaaaggaggaaguauauccucgagaggcauacacugaagaguucgacacaauuaucaacgcccagaaaaauaagcacgacuuuuugaccgaugaagugguccaucagcugagaaacgagauuaucuauuuccagaggaaacuaaagucccaaaagggacucgugucaaucugcgaguuugaaggcuucgagaaaacgguuuuugauaaggaaaagaauaaggacaaaguggucuucgugggcccaaagguagcucccaagacuucaccucuguuucagcuuugucggauuugggagguugugaacaccauaagccugaaaaucaagaauccagaagggucuaaauacaaguggggagagaaaauucccaacuugaaggagaagcagauccucgccgacuaucuguucaaaaaugauuccuuaucauuuacaaagcugcucgaaauacuugaccugaacaaaaaugaugucuacgugaacaagcaaauuuugaaagguaucaagggcaaugagacuuucagcacccuacacacagugcugggggacaacgaacuccugaauuucgaugucaguaucauuccuucuaaccauaccuccaugcuuguugacaagaaaacgggagagauccuggaggaacgugcgggcuuggagcucgaugcaagccuggaaaaggagccauuauaucagcuguggcacacuauuuacucgcuaaaagaccucgaugaaugcaagaaugcccugauaaaacgcuuugguuucgacgaugagacagcugagaaacuuucucauaucgacuuuaacaaacaggccuucgggaacaaguccaauaagucaaugagaaaaauuuugccguuucugauggaaggauacgacuauagucagagcuguucccucgcaggcuacaaccacucuaauagccugaccaaggaugagagggaacaacagaucacucuugaccggcuggaguugcucaguaaaaacagucugcgacagcccaucguggaaaagauuuuaaaucagaugauaaacguagugaaugcuauccuggagcaauauggcaaacuauccgagauucgcgucgaacucgccagagagcugaagcagagcaaggaugaaaggaacgacgcggaucuucaaaauucuaaaaacaagaaauugaaugaggaaaucgggaagcggcuggccgagcucggacugccugugacaaaacgcuacauucagaaguauaaguucaucuuuccaucauuaaguaaaaaccugaaggacgcacacguuaauaaccagugcauauacuguggugagaccuucaaucuuacggaggcuuugagcggcgaugccuuugacguggaucauaucguccccaaagcucuccuguucgacgauucccagaccaacaaggugcuaguacacagaaaaugcaacucuacaaagacuaaucagaccgccuaugacuacauugggacaaagggagaagaacagguuaggguguacucggagcguaucgaugacugguuuaaacggggcauuaucagcuauuccaagaugcaacgacugaaagucucacauaaggaauaccucgagagaaagaagcuggguaaagagacugaaaccgacaagaaacuuugggagaacuucauagauaggcaguugcgcgacacacaguauauuagucggaaagcaagagaaauccugcaaaagguguguaauaacgucaccacuacggaagggggcgugacagccaaauuaaggaaucucuggggaugggaugacguucugaugaaccuucagaugccuaaguacaaagagcugggccagaccgugauuaaggaauggacuucugagcacgggaagcgcaaacaccagaaggaagagaucgaaaauuggaccaaacgagaugaccaucggcaccaugcuauagaugcguugguagucgcaugcacaaagcaaggauuuauccagcguauuaacacccucaauagcuccgacacuaaagaucugaugcagagagagaucaaggaggccaagaaacuacugggugaaaacuauaaugagaaggaguucgaaaacgacaaugaguucgugaaaaaccacaaggaaaggcucucacagcuggaugacuaccuucgcuugcaaaaaccaguuaaguuugauacaaaguauguggagcaggaagcugacaaaguccuggugagcuucaaggccggcaaaaagguagcaacgauuaccaaauuuaaggccacugggaagaauaaagacacaggagugaucguuccccggggcgcuuuacaugaggccggucucuacgggauaagaaccauuuacucuaagggcggaaucgcagaaaaacacaucauuaagaaauauaaggucggcguguccgcgcaggaucacaucuucacagggaaagagacuuacagugugaagaaggacaaaaacggaaacgaaaaggucgaugacaaaauuaagauaguucuggauagcaucguggacaauaaagugaaggagguaguccuuaacaggcugaaucgagguuuuaacaaugaggaagauuaucgcauugacgugaagaaagcucuaaacaauuucaagaaccucgaugaggacccgcugugguacaaugaaucuaaaggcaucaagauuuuguccaucaaacugaagaccggguuaaaggauucaguugugccucuccggcugaacgagaaaaaugaggucauaacgcuugugaagaccggaaacaaucaucacaucgccauuuaugaagacaacgacggcaaacugauccaguacaguuguacauuuuggcaugcaguugagagaaagaaauauaauauucccacugugaucaagaacagcucggaaguauggaaucaagucuuggauaagaaacucccagaguccuuccugaacaggcuaccugccgacaagcugaaccuuaaauuuucuaugcagcagaaugaaauguucauacucggucuguuggaggaggaauuugauaaggcuauuaaagacaacgauaagagccuguuaucaaaauaccucuaccugguguggaguaucgccgagggggacuauugguuccgucaccaccuugaaaccaagaauacagagcugaagaaaacuaacggcgcaaaggaauccaaacgcuacuuucgguugucuaccaagggacucaucgaucugaaucccgugaaagucagacuaaaccaucugggcgagauuacgaagauaggggaguauuga

SEQ ID NO: 2912 - RNA, 3810 nt, Artificial Sequence
  Cas9 variant
augaacaauagcaucaaguccaaacccgaggugaccauuggccuggaccucggggucggaucuguugguugggccauaguggauaacgaaacaaauaucauucaccaucuuggcucaagacuguucagucaggcuaagacugcagaggacaggcggagcuuucgcggggcccgacguuugaucagaaggcggaaauacaaguuaaaacgcuucauuaaccugaucuggaaguauaauuccuacuuuggauucaagaacaaagaagauauacuaaauaacuaucaagagcagcagaagcuccacaauacgguacugaaccuuaaacuggaagcguugaaugcuaagaucgacccuaaagcccucucuuggauucugcaugauuaccugaagaacagaggccacuuuuaugaggacaauagggauuucaacguguacccaaccgaggaacucgcaaauuauuuuggugaguacggguacuauaagggaaucauugacucgaaagaagauaacgacgauaaguuagaggagggccugacaaaauacaaguucucaaaccagcauuggcuugaagagaucaaaaaggucuugagcaaucaaacuggccugccggaaaaauuuaaggaggaauaugagagucuauucuccuacgugcggaacuauucugaggggcccggaagcauaaauuccguuucaccuuacgguauuuaucaccucgacgaaaaggagggcaaagugguccagaaguacaacaauaucugggauaaaaccauugggaagugcaguaucuuuccagacgaauaccgcgcccccaaaaacagcccuaucgcuaugauuuucaaugagauaaacgaacugucuacaauccgauccuauucaauuuaccuuaccggaugguuuaucaaucaggaguucaagaaggcauaucugaacaaauugcucgaccuguuaauaaagacuaauagcgagaaaccaauugaugccagacaguucaagaaacugagggaagagacaaucgcugaaaguaucggcaaggagacccucaaggacguggaacgggaggagaaacuugaaaaggaggaucacaaauggaagcugaaagguuugaagcuaaacacgaaugggaagauucaauacaacgaccugucuucccucgccaaauuuguacauaagcugaaacagcaccuuaagcuggauuucuugcucgaagaccaguauacuacccuggauaaaaucaauuuucuucagagccuguucguuuaccuaggaaagcaucuccguuauucgaaccgcguggacucugcgaaccugaaagaguuuuccgauucaaauaaacuuuucgagagagucuugcaagaacagaaggacgaucuguuuaaacucuucgagcagacagacaaggacgaugaaaagauucuggcacaaacucacagucuuagcaccaaggccaugcuguuggcuauaacaaggaugaccaaccucgacaaugaugaggacaaccagaaaaauaacgauaagggcuggaauuuugaagccaucaagaacuucgaccagaaauuuauugauaucacgaagaaaaauaacaaucuguccuuaaagcaggacaaacgguaccuggaugaccgauucaucaacgaugcaauucuaucucccggcgugaagcgcauacucagagaggcuacuaagguguuuaaugccauccugaaacaauucagcgaggaauacgacgucacaaagguugugauugagcuugcgagggaauugucagaggaaaaagagcuggagaacaccaagaauuaugaaaaacucaucaagaagaacagugauaaaauuuccgagcggcuggaagccuuagacaucgcagaggacaagauagaagauauccugaaaagcccuacuaagucuuacaaaguacuuuuguggcuccagcaggaccacauugauccauauucacagaaggagaucgcuuucgaggacauucugacaaaaaccgaaaagacggagaucgaucauauaauuccguacaguaucagcuuugacgauuccucuucgaacaagcuacuggugcucgccgaaagcaaucaagcuaaauccaaccagacccccuaugaguucauuacaucagggaaugccggaaucaagugggaggacuacgaagcauauugucgcaaauuuaaggauggugacacuucacugcuugauucuacccagagaagcaaaaaguucgccaagaugaugaaaacagacacuuccucaaaguacgauauaggcuuuuuggcuaggaaccugaaugacacccguuacgcgacaaucgucuuccgggacgcauuaaaagauuaugccaacaaucaccucguggaggacaagccuauguuuaaaguugugugcauuaacgggggagucaccagcuuccugcgaaagaauuuugauaagucuugguacgcuaaaaaggacagagauaaaaacauccaucacgccguggacgcauccauuaucaguauauucagcaaugaaacuaagacgcuuuuuaaccagcugacacaauucgccgauuauaaauuguuuaagaauaccgacggcucuuggaagaaaauugauccaaagacugguguaguuaccgaggugacagacgaaaacuggaaacagaucaggguccgcaaucagguguccgagaucgcuaaggucauuaacaaauguauccaggauucaaacauugagcggaaggccagauacaguaggaagauagaaaauaaaaccaacaucagccucuucaaugacacuguguauucggcaaagaaaguuggguacgaggaccaaauuaagcgcaaaaaccugaagacacuagauauccaugaauccgcggaggaaaauaaaaacucuaaggugaagaaacaguucguauaucgaaagcuggucaaugugagccuccugaacaaugacaaacuugcugauuuguuugccgagaaggaggacauucugauguaccgggcaaaccccuggguuaucaauuuagccgaacagauauucaacgaguacacggaaaauaaaaagaucaagucacaaaacguguuugagaaauauaugcucgaucugaccaaggaguucccugaaaaauuuagugaggcuuucgucaaguccaugcuucguaauaaaacugccauuaucuacaacguggaaaagaagguagugcacagaauuaaaaggcugaagauccuaucuagcgagcucaaagaaaauaagcuguccaacguuauaauucgcaguaaaaacgagagcggcacaaaguugaguuaucaggacaccaucaauucuaucgcacugaugauuaugcgguccauagauccaacagcuaagaaacaguacaucagaguccccuuaaacacucucaaucugcaccuuggagaccaggauuuugaccugcauaacauugaugccuauuugaagaaaccgaaguucgugaaauaccucaaggcgaaugagaucggcgacgaauauaaaccuuggagggugcugaccagcgggacgcuacugauucacaagaaggauaaaaaguuaauguacaucucgucauuucaaaaccucaaagacgucauagagaucaagaaucugauugaaaccgaguacaaagaaaacgacgauucugaccccaagaagaaaaagaaagccaaucgauucuugaugacacugaguacuaucuuaaacgauuauauucuccuggacgcuaaggauaauuuugacauccuuggacuguccaaaaaccgcauagaugagauuuugaauagcaagcucggucuggacaagaucaccaaauga

SEQ ID NO: 2913 - RNA, 3810 nt, Artificial Sequence
  Cas9 variant
augaacaauagcaucaaguccaaacccgaggugaccauuggccuggaccucggggucggaucuguugguugggccauaguggauaacgaaacaaauaucauucaccaucuuggcucaagacuguucagucaggcuaagacugcagaggacaggcggagcuuucgcgggguacgacguuugaucagaaggcggaaauacaaguuaaaacgcuucgugaaccugauuuggaaguauaauuccuacuuuggauucaagaacaaagaagauauccuaaauaacuaucaagagcagcagaagcuccacaauacgguccugaaccuuaaaucugaagcccugaaugcgaagauagacccuaaagcauugucguggauccuccaugauuaccugaagaacagaggccacuuuuaugaggacaauagggauuucaacguguacccaaccaaggagcuggccaaauauuuugacaaguacgguuacuauaaagggauuaucgauucaaaggaagacaaugauaacaaacucgaggaagaguuaacaaaguacaaauucagcaacaagcauuggcuggaggaaguuaagaaagugcuuaguaaucagacuggauugccggagaaguuuaaagaagaguaugaaucccuguucucuuacguccggaacuauagcgagggccccggcuccauuaauucagugaguccuuacgggaucuaucaccuagacgagaaggaaggaaaaguaguucaaaaguacaacaauauaugggauaagaccauugguaaaugcaacaucuuuccagacgaguaccgcgcacccaagaauagcccuauugccaugaucuucaacgaaaucaaugagcucucuacaauucgauccuauucaauauaccugaccggcugguuuaucaaccaggaguucaaaaaggcuuaucuuaauaaacuguuggaccuccugauuaagacuaacggggaaaagccaaucgaugcaagacaguucaaaaaguuaagggaggaaacaauagccgagagcauuggaaaagaaacccugaaggacguggagaaugaagagaaacucgagaaggaagaucacaaguggaaacuuaagggccugaaauugaacacgaaugguaagauccaguacaacgaccuaaguucucuggcuaaauuuguccauaagcucaaacaacaccugaaacuugauuuccuguuggaggaccaguaugccacucucgauaagaucaacuuucugcaguccuuauucguguaccuggggaaacaucuacgguauaauaaccguguggacagcgcgaaucucaaggaauuuucggauucuaaccgccuguucgagagaguccuucaggagcaaaaagacggauuguuuaagcuguucgaacagaccgauaaagacgacgagaagauucucgcacagacacacucccugucaacuaaggccaugcuucuggcuaucaccaggaugacaaauuuggauaacgacgaagauaaucaaaagaacaaugacaagggcuggaacuuugaggccauuaaaaauuucgaucagaaguuuauagacaucaccaaaacgaacaauaaccucagucugaagcaggauaagcgguacuuagacgaucgauucauuaaugacgcaauccugagccccggcguuaaacgcauccuaagagaagcuacuaagguguuuaacgccauucucaaacaguucucccaagaguacgauguaacaaagguggucauagagcuggcgagggaacuuucugaggaaaaagaguuggaaaacaauaagaacuauaagaaacugaucaagaaaaauagcgacaagauuucagaggggcucaaagcccuggauaucgcagaggacaagauugaagacaucuuaaaaaguccuaccaaguccuacaaggugcugcuuugguugcagcaggaucacauagacccauauagccagaaagagaucgcuuucgaagauauucucacuaagacagagaaaaccgaaaucgaccauauuaucccguacucuauaucauuugaugacaguagcuccaacaagcugcuaguucuggccgagucuaaucaagcuaaaucgaaccagacgcccuaugaguucauuaccagcggaaaugccgguaucaagugggaagauuacgaggcauauugucggaaguuuaaagacggcgauacaucccuccuggacucaacucagcgcaguaagaaauucgccaagaugaugaaaaccgauacaucuagcaaguacgacauuggguuucuugcuagaaacuugaaugauacuagguacgcgaccaucguguuccgugacgcacugaaggacuaugccaacaaucacuuagucgaagauaaaccuauguuuaaggugguaugcauaaacggaggcguuacauccuuccuccggaaaaauuuugacaagucaugguacgcuaaaaaggaucgagacaagaacauccaucacgccguggaugcaagcauuaucucuauuuucuccaauaaaaccaagacucuguuugaccagcuuacgcaauucgccgauuauaaacuguuuaagaacacagacgguaguuggaaaaagaucgauccaaagaccggggucgugacugaggucaccgacgagaacuggaaacagauaagagugaggaaucagguuagcaagauugcugaagagaucgauaaauguauccaggacucuaacauugaacgcaaggcccgguacuccagaaaaaucgagaauaagacaaacauuucauuguucaaugacaccguguauagugcuaaaaagguaggcuacgaugaccaaauaaagaggaaaaaccucaagacucuggauaucgacgaaagcgucgaggagaauaaaaacucgaaggugaaaaagcaguucguuuaucgcaagcuagugaaugucucccugcucaacaaugauaaacuggcggaccuuuuugcugaaaaggaggauauuuugauguaccgagccaaccccugggugaucaaucuggcagaacagauuuucaacgaguacacagaaaaucggaaaaucaagucucaaaacguauuuggaaaauauauguuagaccucacgaaggaguucccugagaaguuuagcgaagccuucgugaaaucaaugcugcguaauaagaccgcuauaaucuacaacguugagaaaaaggucgugcauagaauuaaaaggcuuaagauccugaguuccgaacuaaaggagaacaaacucucuaaugugauuauccgcagcaagaacgaauccggcacuaaacugucauaucaggauacaauaaauagcgucgccuugaugauuaugcggaguaucgacccaaccgcaaagaaacaguacaucagaguuccccugaacacauuaaaucuccaccugggggaucacgacuuugaucuucauaacauugacgcuuaucugaagaaaccgaaguucgugaaguacuugaaagccaaugagauaggagacgaguauaagccuuggagggugcucaucucugguucccugcuaauucacaaacgagauaagaaacugauguacaucagcucguuucagaaccuuaaugaccucauugaaaucaagaaccugauagagacugaauacaaggagaauguagauucagaccccaaaaagaaaaagaaagcgucucaaaucuugcgcagucuguccaccauuuuaaacgauuauauccuccuggacgccaaggauaauuucgacauucuuggccugagcaagaaccggaucgaugagauacucaauucuaaauuggaccuggauaagauugcuaaauga

SEQ ID NO: 2914 - RNA, 3822 nt, Artificial Sequence
  Cas9 variant
augaagaaaauccugggccucgaccuugggaccaacagcauuggaugggcccugauagagguggaugaaaauaacuuccccaucagaauuaucgcuauggguuccaggauuaucccuuugucuucaaaugacaaggaugaguuucagcggggcuuaaguauaacaaagaaccaaagccgcacugucucccgaacgcagcguaagggguacgacagaaaacagcugaagaagucugaugacuucaaauauucgcuaaggcggauccucaauaaguacaacauuuuuccaucagaggagcugcuuaaacugccgauguuggaucucuggaagcugcgcagcgacgcaguuaaucccaacgaaaauaucagugccgagcagcugggacggauucucuauauguuaaaccagaaaaggggcuacaaguccgcgcggucugaggcuaaugccgauaagaaagacaccgauuaugugcuggcaguaaagggucgcuacgcccagcuuaaagaccgaaaccagacaaucgggcaguauuucuacgaagaguugcacaaugcuaagacuaccaacagcuacuuuagaacaaaagaagagguguauccuagggaggcauacauagaagaguucgauaccauuaucaaugcccaaaaguccaaacaugacuuucugacugacgaagucgugcaccagcuacggaacgagauuaucuauuuccagcguaagcucaagucacagaaaggacugguuaguaucugcgaauuugagggcuucgagaagacaauuuuugauaaagaaaaggacaaaaacaagguggucuucgugggcccaaagguagcucccaaaaccagcccucuuuuucaacugugucgcauaugggagguugugaauacgaucacuuugaagauuaaaaacccagaagggucuaaguacaaauggggagagaagauccccaauauaaaggaaaaagaggcccucgcggauuaucuguucaagaacgagaccuuauccuucaauaaacugcucgacauucuugaacugaagaaagagaacgucuacgugaauaagcagaucaucaaggguauuaaaggcaacgaaacauauucagcauugcauagaauccuaggggauaaugagcugcucaaguuugacgugagcauuauaccuaguaaccacacuucuaugcuggucgauaaaaagaccggagaaauccuugaggagagggccggccuggaauuggacguuucccucgagaaagaaccacuguaccaguuauggcauacaauuuacagcaucaaggaucuggacgagugcaaaaaugcucuaaucaagcgguucgguuuugaugacgagauugccgaaaagcucucgcaccuggacuucaacaaacaagcauuugggaauaagucuaacaaauccaugcgaaagauacuuccguucuugauggagggauauaauuacucacagaguuguacccuggcuggcuauaaccacagcaacucccucacgaaagaugaacgcgagcaacaggugacucuggacaaacuugaacuguugcccaaaaauucucucagacaaccuaucguagagaagauucugaaccagaugaucaauguggucaacgccauuuuagaggaauacggcaagccaagcgagaucaggauagaacuggcgcgggagcuaaaacagucaaaggaugaacgccaugacgccgaucuccagaauaguaaaaacaagaagcugaaugaggagaucgggaaaagacuuacagaauugggacugcccgugaccaagagguauauucaaaaauacaaguuuaucuucccuucccucagcaaaucucugaaggacgcacagguuaacaaucagugcauuuauuguggugagacuuuuaacuuaacagaagcucugucaggcgaugccuacgacguggaucacaucgucccaaagagucuuuuguucgacgauagccagaccaauaaagugcucguacaucguaagugcaacuccacgaaaaccaaucaaacagcuuacgacuauauagccucuaagggggaggaagagguucagauuuacucggcacggguggaugacugguuuaaacgaggaaucauuagcuauuccaagaugcagagacugaaagucucacacaaggaguaccuagaaaggaagagucugaacaaagagacugaaaccgacaagaaacucugggagaauuucaucgaucgccagcugcgggacacacaauauauaucuagaaagagcaaagagauccuucagaagguguguaacaacgucacuaccacagaaggcggugugaccgccaaguugagggaucugugggggugggacgauauuuuaaugaaucuccagaugcccaaauacaaggagcugcgccaaacuguuaucaaagaauggacguccgagcacggcaagcgaaaacaucagaaggaagagauugagaacuggacaaagcgggacgaucaccgucaucacgcuaucgacgcgcuugugauagcaugcaccaaacagggauuuauucagagaaucaauacucugaacucaagcgaaaccaaggauuugaugcaacaggagaucaaugaagccaaaaagcuccugggcgagaacuauaaagacaaggaauuugaaaauucuaacgagcuaguaaagaaucauaaagggaggcuguccaagcucgaugacuaccugcgccuucagaaaccgauuaaguucaacacaaaauacgucgaaaaggaggcugauaagaucuugauuaguuucaaagccggaaagaaaguggcaaccauaacuaaguucaaagccacagguaagaauaaagacacgggcguuaucgugccuagaggggcucugcacgaagccggauuauauggcgucagaaccauuuacagcaagggugggaucgcagagaagcacauuaucaaaaaguauaaagugggcguaucugcgcaggaccauauauuuacuggaaaggaauccuacucagugaaaaaggauaagaacggcaaugagaaaguugacgauaagaucaaagucgugcucgacaguauuguggauagcaaggucaaagagaucguucugaacaggcuuaauuucggguuuucggacggagaagauuauaagaacaacgugaagaaagcucugaauaacuucaagaaucuagacgaguacccccucugguauaacgaaaauaaagguauuaagauccuguccauaaaauugaagacaggccugaaggauucugugguaccauuacgacucaacgagagcaaugaggucauuacccuggugaaaacagggaacaaucaccauaucgccaucuacgaagacaagaacucaaaaccuguucaacacaguuguacuuuuuggcacgcaguggagcgcaagaaauacaauauucccgccgucauaaagaaauccucugauguguggaaccagcuucuggacaaggaauugccagagagcuuccucaauaaccugcccgaagacaaucuaaaccugaaguuuuccaugcagcagaaugagauguucguucuuggacucucacaagaggaauuuaaagaggcuaucgaaaacaacgauaagagccuguugaguaaauaucuguacuuaguguggucuguauccgagaauaacuauugguuccggcaucaccucgaaaccaagaauagcgaccugaaaaagacggagggcgccaaggagucgaaaagacuuuacaacauuaggucagucucuagucuguuuuccuugaauccugugaaggugcgucucaaccaucugggugaaaucaccaaaauuggggaguauuga

SEQ ID NO: 2915 - RNA, 3825 nt, Artificial Sequence
  Cas9 variant
augaccaagcacauccugggccucgaccuugggacaaacagcauuggaugggccauaauccagguggauaauaacaauaacguccccauucaaaucauugcuauggguuccagaaucauaccucuggacucuaaugauagggaccaguuccagaaaggccaggcaaucucaaagaacaaagaucggacuacggcccgcacccaacgaaagggguacgaccguaaacaguugaagaagagugaugacuuuaaauauagcuuaaagaaaauucuggagaagcuagauaucuucccaacagaagaacucaugaaacugccgacucuugaccuguggaaguugagauccgaugcgguuucuaauauugaagacaucacccccaagcagcucggaaggauacuguacaugcugaaccagaaacggggcuauaagucggcucgcucagaggccaaugcagauaaaaaggacacagacuacguggccgaaguaaaagguagauauacccaacucaaggauaaagggcagacuuuaggacaguacuuuuauaaggagcugagcgacgcuaaccagaauaacacauacuacagggugaaggagaaagucuauccucgggaagcauacauugaggaguucgaugccaucauuaaugugcaaaagaguaaacauuccuuucuuaccgacgagguuauccacucuuugcgcaacgagaucauuuauuaccagcgaaagcugaaaagccagaagggccuaguguccauaugcgaguucgaaggcuuugaaacgacuuauuucgauaagaaaacccaacaggacaagacaaucuuuacugggccaaaagucgcucccagaaccucaccucucuuccaguuuuguaagauuugggaggugguaaauaacaucagucugaaaacaaagaacccagaaggaagcaaguacaaauggucugauaggauacccaccauugaggagaagcagacgaucgccaauuaucuucaagaaaacgagaaucuguccuucaucgaauugcucaaaauucugcaguuaaagaaagagcagguuuacgcgaacaagcagauccugaaggguauucaaggcaauacuacauuuucagcaauacauaaaaucauugggaacagcgaacaccucaaguucgacaucgagaccaucccuaguaaacauuucgccgugcuugucgauaagaaaacuggagagauucuggacgaacgggauucuuuggagcuaaauuccgcucuggaacaggagccauuuuaccagcucuggcacacaauauauagcaucaaggaccuggacgaaugcaaaaaggcccuuauuaagcguuucaacuuugaggaggaaaucgcagagaaacugucgaagauugauuucaauaaacaggcuuuuggcaacaagucuaauaaagccaugcgcaagauguugccguaccucaugcuggguuauaaccaauccgaagcggagucauucgccggguacaauagaagguuaaccaaggaggagaaaaguaagaacgugagcgacgaaccccugcagcuacucgcuaaaaauucccugcggcagccuguggucgaaaagauccuuaaccagaugauaaacguugugaaugcaaucauugagaaauauggaaagccagaagagauccgaguagaguuggcccgcgaacugaagcaaucuaaagaugagagagaagacgcugauaagcagaacggcuuuaauaaaaagcucaacgagcugguggccacgaaacuuaccgaacugggcuugcccacaacuaagcacuacauucagaaguauaaauucaucuuuccugcaaaggacaaaaauuggaaggaggcccaagucgcuaaccaguguauauacugcggggauaccuucaaucucacagaggcgcugagcggagacaacuuugauguggaccauauuguuccaaaagcauuacuguucgaugacucacaggccaauaaggugcuaguccacaggaguuguaacuccacuaaaaccaauaacacagcuuacgauuauaucaccaagaaggguagccaggcccucaaugacuacguggcacggguagacgauugguuuaaacgcggcauuaucucuuaugggaagaugcaaagacugaaaguuucauucgaagaguaccaggaaaggaagaaaauaggaaaggagacugaagccgacaagcguaucugggagaacuucauugaucggcagcuucgagagacggcuuauaucgccaaaaaggcaaaagaaauuuuggagaaggugugccauaaugucacaaguaccgaaggcaacgugacugcgaaacugagacagcucugggguugggacaacguccugaugaauuuacaacugcccaaguacaaggagcuugagaaaaagaccaaacagacauuuacccaguugaaggaauggacuagcgaucacgggaacaggaaacaccagaaggaggaaaucauaaauuggacaaagcgcgacgaucaucggcaccaugcuauugacgcccucgugaucgcauguacgcaacagggcuucauccagagaauuaacacccuguccucuucggauguuaaagacgagaugaagaaagaacuagaggaggauaagacuguguauaaugaaaggcugacacuccuggagaacuaccuuuuggagaaaaagccguuuagcaccgaagaaaucgagaaggaggccgacaaaauucugguauccuucaaggcuggcaaaaaggucgccacauuaucaaaauacaaggcaacuggaauaaaugaaaucaaaggggugcucguuccucgcggaccccugcacgagcaaaguguguaugguaagauuaaggucaucgaaaaagauaagccacuuaaauaccuguuugagaacucugacaagauugugaauccuuugaucaaacaucucguaaagacccgacugcuagaaaacgagaauaacgcucaggccgcgcuggugacgcucaagaauaaacccauacugcuuaacaauaagcagaccgagaucuuggaaaaagccagcugcuauaacgaggcuacaguucugaaguacaaauuacagucccucaaggcaucacaaauugacgauaucgucgacgaaaagauuaaauuccugaucaaggagcggcuuagcaaauuuggcaacaaggagaaagaagccuucaaggauauacugugguuuaaugagaagaaacagauuccaaucacuucuauccgucuauucgcuagacccgacgccaacaaucuccaggugauuaagaaacacgaaaaggggaaaaacauaggauuugugcuguccggcaauaaccaccauaucgcaauuuaugaggauaagaauaacaaauugauccagcacauuugugacuucuggcaugcggucgaaaggaagcgcaauaacaucccuguucugauagaggauaccaguacaaucuggaaucacuuaauuaacgaggacuuuagcgaaucuuuccucaauaagcugccaaacgauucccuuaaacugaaguucucauugcaacagaaugagauguuuauccucggucugccgaaagaacagagugaggaagccauuaagagcaacaauaaaucgcuacuguccaagcaccuuuaccucguguggucuaucacugacggggauuauuucuuucggcaucaccuggagaccaagaacacggaguugaaaaagauagacggcagcaaagaaucaaagagauaccugagguuaaguacaaaaucccucguggaccugaaccccauuaagguacgacuuaaucaucugggagagaucaccaagaucggcgaauga

SEQ ID NO: 2916 - RNA, 3846 nt, Artificial Sequence
  Cas9 variant
auggaggacgauagccagcacgacaucagagaaauuuaccuggccauacaucacauggugaaguauaggggcaacuuccucgucgaggggacccuugaauccucuaaugcuuuuaaagaggaugaacuguugaaguuacugggacggaucacacgcuacgagaugucagagggugaacaaaacagugacauugagcaggaugacgaaaauaaacuuguugcacccgccaacggccagcucgcggaugcucugugcgccacucgagggagccguuccaugagaguggacaaugcacuugaggcccugucugcuguaaacgauuugucgagggagcagcgggcaaucgugaaggccauuuucgcuggacucgaaggcaauaaacuggaccuggccaagaucuuugucucaaaggaguucagcagugaaaacaaaaagauacucgguaucuauuuuaauaaauccgauuacgaggaaaagugugugcaaauuguugacucuggguuacuggaugacgaggagcgcgaguuccuugacagaaugcagggacaguauaacgcgaucgcauugaaacagcugcuaggcaggagcacguccgugucagauaguaagugcgccagcuacgacgcucaucgggccaauuggaaccucauuaagcugcaacuucgcaccaaagaaaaugaaaaggauaucaacgagaauuauggcauacuggucggguggaaaauugacucuggacagcgaaaguccgugagaggugaaucagcauacgagaacaugaggaaaaaggcuaacguauuuuucaaaaagaugaucgagacaagcgauuugagugaaacugacaagaaucggcucauucacgauaucgaggaagacaaacuguuuccuauccagcgugauucugacaacggcguuauuccacaucaguuacaccaaaaugagcugaagcagauaaucaaaaagcaggggaaauacuauccguuccuccuugaugccuuugaaaaggacggaaagcaaauuaacaaaaucgagggccuguuggcguuccgcgugcccuacuuugucgguccucuaguggugccagaggaccugcagaaguccgauaauagcgaaaaccacuggauggucaggaaaaagaaaggggagauaacccccuggaauuucgacgaaaugguugauaaggacgccucgggaagaaaguucauugagcggcucgugggcacagauucuuaucugcuuggcgagccuacccugcccaaaaacuccuugcucuaccaggaauaugagguacugaaugaauuaaacaaugugcgacugucaguccgcacugggaaccauuggaaugacaagagaaggaugcggcuaggacgcgaggagaaaacacuccugugucagagacuuuuuaugaagggucaaaccgugacgaaaaggacugcagaaaacuugcugcguaaggaguacggccggaccuaugaacucagugggcugagcgaugaguccaaguucacaucuagccuuucaacuuacggaaaaaugugccgaaucuuuggcgaaaaguacguuaaugagcacagagaccugauggagaaaaucguggaauugcagaccgucuucgaggauaaggaaacacuccugcaucaguuaaggcagcuggaggguauuagugaagcugacugugcccuacucgugaacacccacuauacgggguggggccgccugucccggaaacuuuugacuacaaaggcuggagagugcaaaaucagcgaugacuuugccccaagaaagcacucuauuauagaaaucaugagggcagaggaucgcaaccugauggagauuaucaccgacaagcaacucggcuucucagacuggaucgaacaggagaaucugggggccgaaaacggaaguagcuuaauggagguaguugaugaccugcgaguguccccuaaagucaagcgggguauuauacagucuauccgucuuauugaugacaucucgaaagcugugggcaagagaccaagcaggaucuuuuuggagcucgcggaugacauucagccguccgggcgcacuauaucacggaaaaguagacugcaagaucuauacaggaaugcaaaccugggaaaggaguucaagggcaucgccgacgaacucaaugcuuguucugauaaagaccugcaggaugaccgacuauuuuuguauuacacacagcuggguaaggauauguauaccggggaagaguuagaccucgaccgccugagcuccgccuacgauauugaccauaucauuccccaggcagucacgcaaaacgauucaaucgacaaucgggugcuuguugccagagcugaaaacgccaggaaaaccgauagcuucacauauaugccucagauagcagaccguaugcgcaauuuuuggcagauucuguuggauaacggccucaucucucgggugaaguucgagagacugacuaggcaaaaugaguuuuccgaacgagagaaagaacgguucguacagcgcagucuagucgagaccagacagauuaugaagaacguggcgacacugaugaggcagcgguacggaaauagcgcugccguuaucggccucaacgcagaacugacuaaggagaugcaccgauaccuuggguucucucauaaaaauagagacauaaacgauuaucaccaugcccaagacgcuuugugcgugggaaucgccggucaguuugcagcuaaccgcggcuucuuugccgauggggaggucuccgacggagcgcaaaauucauacaaccaguaucugagggacuacuuacguggcuaucgggaaaagcucagugccgaggauagaaaacaggguagggcuuucggguuuauugugggcagcaugcgcucgcaggacgaacagaagcgaguaaauccaagaaccggagaggugguuugguccgaagaggauaaagacuaccugcggaaggucaugaacuauaggaagaugcuugugacacagaaagugggcgaugacuucggggcacuguacgaugagacccgcuacgccgcuacugaccccaagggaaucaaaggcauuccuuuugauggugccaagcaagacacgucucuauaugggggauucagcucagcaaaaccagcguacgccguccucaucgaaaguaagggcaaaacacgucugguuaaugugaccaugcaggaguauuccuugcugggugauagacccucugacgaugaauuacggaaggugcucgcuaagaaaaagagcgaguacgccaaagcaaacauacugcuuaggcacguaccgaagaugcagcugauucgcuauggcgggggauugauggucaucaaauccgcuggcgagcucaauaacgcccaacagcuguggcuaccuuacgaagaguauuguuacuuugacgaccugucacaggggaagggaagccuugaaaaggaugaccucaaaaagcuguuggauaguauccugggcucugugcagugcuuauaccccuggcaccgauucacugaggaggaacucgcagaccugcauguugccuuugauaaacuuccagaggacgaaaagaaaaaugugauuaccgguaucgucuccgcucugcacgcggaugccaagacagcaaacuugagcauuguggggaugaccggaucguggagacggaugaauaacaagucaggcuauacuuucucugacgaggaugaauuuauauuccaaaguccuuccggucucuucgagaaaaggguuacagugggcgaacugaagcgcaaagcuaagaaagagguaaauagcaaguacagaacgaacgagaagaggcuacccacccugucuggggccagccagccauga

SEQ ID NO: 2917 - RNA, 3861 nt, Artificial Sequence
  Cas9 variant
augaccaagaacauccugggccucgaccuugggacaaauagcauuggaugggcccugauagagguggaugaaaacaauacucccaucagaauuaucgcuauggguuccaggauuaucccuuugucuacgucagacaaagaggaguuccagcggggcuuaaguauaaccaagaaccaaagccgcacagucucccgaacucagcguaaaggguacgauagaaagcagcugaaaaagucugaccuaaagaaaauccucaauaaguauaacauuuuuccaucggaggaacugcuuaaacugccgauguuggaucucuggaagcugaggucagacagcgcaaaucccaacgagaauaucagugccgagcagcugggacggauucucuacauguuaaaccaaaaacgcggcuauaaguccgcgagaucugaagcuaaugccgauaagaaagacaccgauuacguucaggcagugaaggguagguaugcccagcugaaagagcggaaccagacaaucgggcaauacuucuaugaggagcuuuacaaugcuaacaccaauaacagcuacuuucgcauaaaggaggaaguauauccucgagaggcauacacugaagaguucgacacaauuaucaacgcccagaaaaauaagcacgacuuuuugaccgaugaagugguccaucagcugagaaacgagauuaucuauuuccagaggaaacuaaagucccaaaagggacucgugucaaucugcgaguuugaaggcuucgagaaaacgguuuuugauaaggaaaagaauaaggacaaaguggucuucgugggcaguaagguagcuccaaagacuagcccccuguuucagcuuugucggauuugggagguugugaacaccauaucucugaaaaucaagaauccugaaggguccaaauacaaguggggagagaaaacaccaaacuugaaggagaaggaaauucucgccgacuaucuguucaaaaaugauucacugagcuuuacuaaguuacucgagauccuugaccugaacaaaaaugaugucuacgugaacaagcagauauugaaagguauuaagggcaaugaaaccuucagugcgcuacacacagugcugggggacaacgagcuccugaauuucgaugucucuaucauccccuccaaccauaccagcaugcuuguugacaagaaaacgggagaaauucuggaggagcgugcaggcuuggaacucgaugccucgcuggagaaggaaccuuuauaucaacuguggcacacuaucuacucucuaaaagugcucgacgagugcaagaaugcucugauuaaacgcuuugguuucgaugacgagacagccgaaaaacuuucccauauagauuuuaacaaacaggcauucgggaacaagucaaauaagaguaugagaaaaaucuugccauuucugauggagggauacgacuauagccaguccuguucucucgcuggcuacaaccacagcaauucacugaccaaggacgaaagggagcagcaaauuacucuugaucggcuggaauugcucaguaaaaacucccugcgacagccgaucguagagaagaucuuaaaucagaugauuaacguggucaaugccauacuggagcaguauggcaaacuaagcgaaauccgcguggagcucgcgagagaacugaagcaaucuaaggacgagaggaacgaugccgaccuucagaauaguaaaaacaagaaauugaaugaagagauugggaagcggcuggcagagcucggacugcccguuacaaaacgcuacauccagaaguauaaguucauuuuuccuucauuaagcaaaaaccugaaggaugcucacgugaauaaccagugcaucuacuguggugaaaccuucaaucuuacggaggccuuguccggcgacgcuuuugaugucgaccauauagugccaaaagcccuccuguucgaugacucucaaaccaacaagguucuaguacacagaaaaugcaacucgacaaagacuaaucagaccgcauaugauuacaucgggacaaagggagaagaacaggugaggauuuacagcgaacgugucgacgauugguuuaaacggggcaucauuuccuauucaaagaugcagcgacugaaagugagucauaaggaguaccucgagagaaagaagcuggguaaagaaacugagaccgacaagaaacuuugggaaaacuucaucgacaggcaauugcgcgauacacaguauauaucucggaaagccagagagauucugcagaaggucuguaauaacgugaccacuacggaagggggcaucacagcuaaauuaaggaaucucuggggaugggacgauguucugaugaaccuucaaaugcccaaguacaaagaacugggccagaccgugauuaaggaguggacuagcgaacacgggaagcgcaaacaccagaaggaggaaaucgagaauuggaccaaacgagacgaucaucggcaccaugcgauagacgcauugguagucgccugcacaaagcagggauuuauccaacguauuaacacccucaauuccucagauacuaaagaccugaugcagagagagaucaaggaagcuaagaaacuacugggugagaacuauaaugaaaaggaguucgaaaacgauaaugaguucgugaaaaaccacaaggagaggcucagccagcuggacgauuaccuucgcuugcagaaaccuguuaaguuugacacaaaguauguggaacaagaggccgauaaaguccuggugucuuucaaggcaggcaaaaagguagccacgauuaccaaauuuaaggcuacugggaagaauaaagacacaggagugaucguuuuacggggcgcccuccaugaacaguccgucuacgguaagauaaaagugauugagaaggacaaaccacugaaguaccuuuucgaaaacaguaaaaagaucgugaaccccaagaucaaaguccugguugaggagagacuagcagaaaaugagaacaauagcaagcucucucuguccaccuugaaaaagaacccgauuuuucugaaugaagagaaaacagagaucuuagaaaaggcgucauguuauaacgaugcuacugugcucaaguacaaacugcagagucuuaaggccagccaggcagacgauauuguggacgauaggguaaaauuccuggucaaggagcgauuggcccaauuugggaauaaagaaaaggaggcuuucaaggacacccucuggcugaacgaagagaaacagauaccuaucauuacggugcgccuauuugcccggcccgaugcaaauaaccugcaggcuaucaagaaagacaagaauggcagagauauuggauucguucuuaccggcaacaaucaccacaucgccauauaugaggacaaagauaacaagcucgugcaacauucgugcacauuuuggcacgcggucgaaaggaagaaaaauaacgugccagccguuaucaaaaauuccucugacguguggaaccagcuguuggacaaagagcugccugagagcuucuuaaacaagcuccccauugauaaacugaaacuuaaguuuucacugcagcagaaugaaauguucguauuggggcuccugcaagaagacuucgaggcugcaaucgagaacaaugauaagacucuacugaguaagcaucuuuaccucgucugguccauuaccgacggagauuacuuuuuccgucaccaccuggaaacaaagaacacugaguugaagaaaaccgaaggugccaaggagucuaaacgcuauuuucgguuaagcacgaagggccugaucgaccucaauccagugaaggugagacugaaccaucuuggggaaauaacaaaaauuggagaguauuga

SEQ ID NO: 2918 - RNA, 3864 nt, Artificial Sequence
  Cas9 variant
augaagaccgugcugggccucgaccuugggacaaacagcaucggaugggcccugauugaguuggaugaaaauaacauacccaucagaauugucgcuauggguuccaggaucauuccuuuaucuacuucagacaaagaggaguuccagcggggccugaguaucacgaagaaucaaagccgcaccguuucccgaacacagcguaaaggguacgauagaaagcagcuaaagaagucuuaucucaagaaaauacugaacaaguacaauaucuuuccaucggacgagcuucugaaauugccgaugcucgaucuguggaagcugaggucagacagcgcaaaccccaaugaaaacauuagugccgagcagcucggacggaucuuauauaugcugaaucaaaaacgcggcuacaaguccgcgagaucugaggcuaacgccgauaagaaagacacugauuauauucaggcagugaaggguagguacgcccagcuuaaagaccggaaucagaccaucgggcaauauuucuacggagaauugaacgaugcuaaugagaacaauagcuacuuucgcauaaaggaagagguauauccucgagaggcauacacagaagaguucgacaccauuaucaacgcccagaaagauaagcacgacuuucugacugacgaagugauucaucagcuaagaaacgagaucaucuauuuccagaggaaacucaagucccaaaagggccuggucucaauuugcgaauuugagggcuucgagaaaacaguguuugauaaggagaaaaauaaggacaaaguuguguucgucgggccaaagguggcucccaagaccaguccucuuuuucagcugugucggauaugggaaguaguuaacacgaucacuuugaaaauuaagaauccagaaggaagcaaauacaaguggggugagaaaauccccgaugugaaggaaaaggagauacucgccgacuaucuguucaaaaacgagucuuuauccuuuaccaagcugcucgaaauucuuaaacugaauaagaacaaugucuacuucaacaaacagaucuugaagggcaucaaggggaaugagacauauucaauucuacacagcauccugggagauagugaacuccugaacuucgacgugucuauuauaccuuccaaucauacuagcaugcuuaucgauaaaaagaccggcgagauucuggaggaacgugcggguuuggagcucgacacaucgcuggaaaaagagccauuaaaccaacuguggcacaccaucuacucuaucaaggaucuagacgaaugcaaauccgcacucauuaagcgcuuuggguucgaugacgagacggccgacaaacugucaagaauagauuuuaauaagcaggcuuucggaaacaagaguaauaaaagcaugaggaagauccuuccguuuuugauggagggcuacgacuauucccagucuuguagccuggccggcuacaaccauucaaacaguuucacuaaagaugaacgggagcagcaaauuacacucgacaagcuggaacuucugcccaaaaauuccuugcgacagccuaucguggagaagauucucaaccagaugaucaaugucguuaacgcaauacuggaacgcuaugggaagccaagcgagaucagaguggaguuagcuagggaacugaaacagucuaaggaugagcggaaugacaccgaucuacaaaacaguaaaaauaagaaacucaacgaagagauuggaaagcgccuggccgaacuugguuugccccugacuaagagauacauccagaaauauaaguuuauuuucccuucacucagcaaaaaucugaaggacgcgcacguaaacaaucagugcaucuacuguggcgagacauuuaacuuaaccgaggcccuguccggggaugcauucgacguggaucacauagucccaaaagcucuuuuguuugacgauucucagacgaauaaggugcucguucauaggaagugcaacucgaccaaaacaaaucaaacugccuaugacuacauugcuaccaagggagacgaacaggugcgugucuacagcgagcggguggaugacugguucaaacgaggcaucauuuccuauucaaagaugcagagacugaaaguaagucacaaggaauaccuagagaggaaaaagcuggguaaggaaacagagacugauaaaaagcucugggagaacuuuaucgaccgccagcugcgggauacccaauauauaucuagaaaaagcagggaaauccuucagaagguuuguaacaauguggccacaaccgaagggggcgucacugcaaaauugcgcaaccuguggggaugggacgauguguuaaugaaucuccagaugcccaaguacaaggaacugggccaaacggucgugaaagaguggacauccgagcaugggaagcgaaaacaccagaaggaagagauugaaaacuggaccaaacgggacgaucaccgucaucacgccaucgacgcucuuguuguggcgugcacuaagcagggauucauucagagaaucaauacccugaacucaagcgagacaaaggauuugaugcaacaggaaauaaaagaggcaaagaaacuccugggugagaauuauaacgaaaaggaguucgaaaauaacaaugagucugucaaaaaccauaaggaaaggcuaucccagcuggacgauuaccuccgccugcagaagccgguaaaauuugacaccaaguauguggagcaagaggccgacaaaguucuugugaguuucaagagcggcaaaaaggucgcuacuauuacaaaguuuaaagccacggggaagaauaaagauaccggagugaucguaccucggggcgcauugcacgaacagaacguguacgguaagaucaaaguuauugagaaggacaaaucucugaaguacuuauucgaaaauuccgagaagaucgucaaccccaaaauuaagaacauaguggaaaucauucucucagagaaugagaacaauaguaaaauggcccugagcacucuuaagaaaaacccaaucuuucugaaugaagagaagacagaucuacucgaaaaggcuucguguuaugaguacgugaccgucagaaaauauccucugaacacaauuaaggccucccaggcagacgauaucguugacgagagggugaaauucuuggugaaggaacgacugacucaguuugggaauaaagagaaggaagcguucaaggauaccuuaugguuuaacgaggaaaaacaaauacccaucauuacgguacgccucuucgcucggccagacgccaauaaccugcaggcaaucaagaaagaugagucuggcaaggagauuggauuugucgugaugggcaauaaccaucacaucgccauauacgaagacaaagaugggaaacuuguucagcacagcugcaccuucuggcaugcuguggagagaaagaaauauaauauuucaacagucaucaagaacaguuccgacgccuggaaucaauuucuggacaacgaauugcccgagccuuuccucaauaaacugccagcagauaaccuaaaccugaaguucucucuucagcagaaugaaauguuuauccucggacugagccaggaggaguucgacaaggcuuugaaguccaacgauaaaucacuguuaagcaagcaccucuaccugguguggaguauuucugaaaauaacuauugguuuaggcaucaccuugagacuaaaaauuccgaccugaaaaagaccaacgguguuaaagaaagcaagcguuuguacaauauacgcucgcucggcucacuguucucucuaaacccgaucaaaauucggcugaaucaccuuggggagaucacaaagauuggagaauacaguuga

SEQ ID NO: 2919 - RNA, 3867 nt, Artificial Sequence
  Cas9 variant
augagacuguucgaggaaggccacaccgccgaggacaggcggcucaagcgcacagcucgacguagaaucagcaggcggcgcaacagacuuagguaccugcaggcauuuuucgaagaggccaugacugauuuggacgaaaauuucuucgcgcgguuacaagaguccuuucuggugcccgaggauaaaaaguggcaucgccacccuauuuucgcuaaacuagaagacgaggucgccuaucaugaaacguacccaaccauauaucaccuccgaaagaaacuggcagauucuucagagcaggccgaccuuagacugaucuacuuggcucucgcacauauuguuaaguauagggggcacuuucugaucgagggaaagcugaguacagaaaacacuagcgugaaagaucaguuccagcaauuuaugguaauuuacaaucagaccuucgugaacggugagucccggcucgucucugccccguuacccgaaucggugcugaucgaggaagaacuuacagagaaggcuucacguaccaaaaagagcgaaaaaguuuugcagcaguuuccucaagagaaggccaauggccuguucgggcaguuucuaaagcucauggugggaaacaaagcggacuucaagaaagucuucggccuggaagaggaagcaaagauaacuuaugccagugaguccuacgaggaagaucuugaggguauccuggcuaaagugggggacgaauacucugauguauuuuuggccgcaaagaauguuuaugacgcuguggagcucagcacaauucuggccgauuccgacaaaaagucacacgcgaaguuaaguagcucuaugaucguccgcuucaccgaacaucaggaggaccugaaaaaguuuaaaagauucauuagggagaacugcccagaugaauacgacaaucucuuuaagaacgagcagaaagauggauaugccggcuacaucgcacacgcuggcaaggugucccaacuuaaguucuaucaguacgugaaaaagauaauucaggacaucgccggggcugaauauuuucuggagaaaauugcccaagagaauuucuugcggaagcagcgaacguuugauaacggagucaucccccaucagauccaccuagcagaacugcaggccauuauacaccgccaagcugcguacuacccuuuccucaaagagaaucaggaaaagaucgagcagcugguuacuuuuaggauuccauauuacguggguccccuuucaaagggcgacgcaagcaccuucgccuggcugaaaagacagagugaggagccuauccggccauggaacuugcaagagacaguagaucucgaccagucugcuacugccuuuauagaacgcaugaccaauuucgauacauaucugccguccgagaagguguuacccaaacauagccugcuauacgaaaaguucauggucuuuaacgagcucaccaaaauuucguauacggacgauagagggaucaaggcaaacuucucuggaaaggaaaaagagaagaucuuugacuaccuguucaaaacuaggcguaaggugaaaaagaaagacauuauccaguuuuaucggaaugaguacaacacagaaauuguuacccuuuccggcuuggaggaagaucaguucaaugccucauuuaguacuuaccaagaccugcucaaguguggucugacacgagcugagcuugaucacccugacaacgccgaaaagcuggaggauauaaucaaaauuuugaccaucuucgaggacagacagaggauccgcacgcagcucagcaccuuuaaggggcaguucuccgcagaagugcugaaaaaguuagagcggaaacauuauacaggauggggcagacugucuaagaagcuaauuaauggcauauacgauaaagaaagcgggaagacuauccucgacuaucuggucaaagaugacggagugucaaagcacuacaacaggaauuuuaugcaacuuauuaacgauagucaguuguccuucaaaaaugcgauccagaaggcucaaagcucugagcaugaggaaacccugucagagacaguaaacgaacucgccgguaguccagcaauuaagaaaggcaucuaucagagccugaagauaguugacgaguuaguggccaucaugggguacgcucccaaacgcauugucguggaaauggcccgagagaaucagacuaccuccacaggaaagcggcguucuauccagagacugaaaauugucgagaaggcaauggcugaaaucggcucgaaccuuuugaaggagcaaccuaccacuaaugaacagcucagggauacgcgccuguuucuauauuacaugcagaacgguaaagacauguacacaggggacgagcugagccuccaccggcugucccacuaugauauagaccauauuaucccacagucauucaugaaggaugacagucuugauaauuuggugcugguuggcucuaccgaaaacagaggaaaaagcgacgaugugcccuccaaggagguagucaaagacaugaaggccuacugggagaaauuauaugcggccggccucauuucacaaaggaaguuccagcgacugacuaagggggaacagggaggucuuacccuggaggauaaagcucacuuuauccagcgccaauugguggaaacacggcagauaaccaagaacguugcaggcauccucgaccagagauacaaugccaaaagcaaggagaaaaaggugcaaauuaucacucugaaggcuucucuaacaucccaguucaggaguauuuuugggcuguauaaaguccgugaagugaacgauuaccaucacggacaggacgccuaucucaauugcguaguggcaacgacccugcuuaagguuuacccgaacuuggcgccugaguucgucuacggcgaguaucccaaauuucagacuuucaaggaaaauaaagccacagcuaaggccaucauauacaccaaccuguuacgcuuuuucacagaggaugaaccacgguuuacuaaggacggugagauucucuggagcaauucuuaucugaaaaccaucaagaaagagcuuaacuaccaccaaaugaauaucgugaagaaaguggaaguccagaaagggggcuucuccaaggagucaauuaaaccuaagggacccaguaacaaacugaucccaguuaagaauggccuagacccccagaaauaugggggauuugauagcccugugguggcauacacgguacucuucacccaugaaaaggguaagaaaccacugauuaagcaggagauauugggcaucacaauuauggaaaagacuagauucgagcaaaacccgauccuguuuuuagaggaaaagggguuccucaggccccgaguccugaugaaacuuccuaaguauacccuguacgaguuuccagaaggacggcgcagauugcucgcuucggccaaagaggcacagaagggcaaucagauggugcugcccgaacaccuacugacacuucucuaccaugccaagcagugucuguugccuaaccaauccgagucucuggcuuauguugagcagcaccagccagaauuucaggagauuuuagaaaggguggucgacuuugcggaggugcauacucucgccaaaagcaagguucaacagaucgugaaacuguucgaagcaaaucagaccgcugauguaaaggagauagccgccucauuuauccaacuuaugcaguucaacgcuaugggugcacccaguacguuuaaauucuuucagaaggacauugagcgggcccgauacacauccaucaaggaaauuuucgaugcgaccaucauauaucagucuccgacugggcuguacgagacaagacgcaaagucguggacuga

SEQ ID NO: 2920 - RNA, 3903 nt, Artificial Sequence
  Cas9 variant
auguggggcgugagccuguucgaggccgggaagaccgcugcagaaagaaggggauaccgguccacacgccgacgucucaaccacagaaaauuuaggcuucggcuguuggaggacauguucgaaaaggagaucuuaucuaaagaucccucauuuuucauucgccugaaggaagccuuucuaaguccuaaagacgagcagaagcaauucaaggguaauauacucuuuaacgauaaagacuauacugaugcggacuacuaugagcaguacaagacgaucuaucaucugagauacgaucuuauuagccagcacaggcaguucgacauccgggaagucuaucuggcuauucaucacuugaucaaauaccgcggccauuuuauauacgaggaucaaaccuucacaacugacgggaaucagcuccagcaccacaucaaggccauuaucaccaugauuaacuccacacugaaucgaaucauaauuccagaaaccaucgauauuaacguuuuugagaaaauccugcucgacagaaugaugaauaggucuucgaaggugaaguucuuaaucgagcugacuggagaagauaaacaggacaagccgcuuuugaaagagcuguuuaaccuaauuguaggccucaaggcaaaacccgccucaauauucgaacaagagaaucuggcuacaaucguggaaaccaugaacaugagcacggagcagguccagcuugaccuguugacucucgcagaugugcuggccgacgaggaauaugauuuacugcucaccgcucagaagauuuacagugccaucauacuugacgaguccauggaugguuaugaauacuucgcggaggcaaagaaggaaucuuaucggaagcaucaagaggagcugguuuuggugaaaaagaugcuaaaaagcaaugccauuacaaacgacgaacgugcuaaguuugaguacuucuauacugauuacaucggggccaaauccucaaauuacgaagagaguaagaacaucaagaaaggacugagcgcagcuuauggcaaguacucuaaagaagaacgccucuuuaagcacauugagcugcuucuggccaaagaaaaugucuugaccacaguggagcaugcgcuccuggaaaagaacaucaccuucgccuccuuacugccucuacagagaucaagcaggaacgcaguaauuccauaucagguucacgagaaggagcucguggcuauacuggaaaaucaagccacguacuaucccuuucuuuuggagcagaaagacaacauccacaagcugcucacuuuccggauuccuuacuaugucggcccacuggcugaucagaaagacagugaauuugccuggauggugcgaaagcaggcagggaaaaucacacccuucaauuuugaggaaaugguggauaucgacgccucuuccgaggcuuucauuaagcgcaugaccaacaagugcacuuaccuuauacaugaggacgucaucccuaaacacagcuuuucguacgcgaaguucgaaguucugaaugaguugaacaaaauuagacucgauggaaagccaaucgacauuccgcugaaaaagaggaucuuugaagguuuauuccuggagaaaacaaaggugacccaaacgucucuaaagaaauggcucgcagaacaugagcacaugaccguauccgugguccagggcacacagaaggagacugaguucgccaccucacugcaggcuuuucaucgguucgugaaaauauuugaucgcgagacaguuaguaaucccgccaacgaagagauguucgaaaagaucauuuauuggagcacuguguuugaggacaaaaagaucaugagaaggaaacuuuccgaguacccucaauugaccgaacagcagcagguccaacuggcacaggugcguuuccggggguggggacgacucucucagagacugauuaauaggaucaaaacaccaguaagcggcgaugaggaccacaaguuaucaauaaacgaaauucuguggcagaccaaugagaacuuuaugcaaaucauucgcaauaaagauuaucuuuucaagaaaaucauagaggaacaguuugagaacgaaacugccuugcucaauaagcagcggaucgacgagcuggcugccagucccgcaaacaagaaagguauuuggcaagcgaucaagauuguuaaagaacuagagaaggugcugcagcagccugcugagaacaucuucauagaauuugccagauccgaugaggaaagcaaaaggucuacgccacgcgacaaguucauugagaaggcauacgcccagcucaaaaaggaaacagauaccuuuaaucuggagcaccuuaaagaguugaagcaacgaucaaaacagcugaguagccagcgguuauuccucuauuucauccagaacgggaaguguauguacuccggagaacaucuggacaucgagcgucuugauucuuaugaagucgaccacauucugccccaaucguacaucaaagacaauagcauugagaacuuggcucucgugaagaaggucgaaaaucagaggaaaaaggauucccugcuacugaacucaaguauaaucaaucagaacuacucuagaugggagcagcucaaaaaugccggccugauuggcgagaagaaauuucgcaaccuuacucggaccaagaucacagacagagauaaggaaggguucauugcaaggcaauugguggagacccgacagaucacuaaacauguuacacagcuguuacaacaggaauauaaggacacgaccaaaguguuugcuauaaaggccacucucguaagcggacugcgccggaaauucgaguuuaucaagaauagaaacgucaaugauuaccaccacgcgcaggacgccuuccuuguggcuuuucuggguacaaacauuaccuccaauuauccgaagaucgagauggaauaccuauucaaaggcuaucagcauuaccucaacgagguugggaagucagcagccaaaccuaaguuuacauucauuguggaaaaccugagcaaacaacaguauaauucuacuaccggagaggucaaguggaaccccgaaguggauaucgcuaaguugaaaaggauacugaauuuuaagcagugcaacauuguacguaaaguggaggagcaguccggcgccuuauucaaggaaacgaucuacccaguugaggaaaguagcucuaaaaccaucccucucaagaagcaccuggacacagcaauuuacgguggguauacugcggucaauuacgccuccuaugcucuuauacaauucaaaaagggccgcaaacugaagcgggagaucauuggaauccccuuggccgugcagaccagaauugauaacucagaaacaagucuccaggcauacaucgcugagcagauaaaaagcgagguggaaauccugaauggcaggauucuaaaguaucaacugaucucgaacaaugggaaccgacuuuacauugccggaccauccgagcggcauaaugcacgccagcucaucgucucugacgaagccgcuaaaguuauauggcugauuagcacuaagcaggcggaugaggccauguuuuugaaguauuacagacuggaacacuuagaggcaguguucgaggaacucaucaggaaacaggcugccgacuaccaaaucuuugagaagcugauuaaaaagaucgaagugaacaaaguauauuucuacucauguaccuauaaugagaaggucaaggugauagaggaacuucugaaaauuacgcaggccaacgcuacaaauggugauuugaagcuccugaaaaugaguaaccgggagggccgacuaggguccguuucuguggcacuggacuuuaagaucauuaaccagagcgucaccggacuuuaccaauccaucgaagacuauaauaacuga

SEQ ID NO: 2921 - RNA, 3930 nt, Artificial Sequence
  Cas9 variant
augggcagcgugggguucgccggaaucgacaaccaguacaaucuggucagaaccaaggguaaaaacguuauuggcgugaggcucuuugaugaggcugacuccgcagccgaacggcgcgggcaccgaacaaaucguagaaggcuucaacggcgcagauggaggcugcgguuguuagaugacauauucgcgaagccccugcaggcuguagauccuaacuuucuagcccgccucaaauauucuuacgugaauaagaaagaccagggacagcaagaucauuauuacggcgguuaugucuucgggucaacugcagccgaccaggcuuaccaccaggcauauccaacgaucuaccaucugcgaaagagacuuauggaggaugaccagaagcacgaucugagggaaguguacuuggccauucaucacaucguuaaauaucggggaaacuuucucaauccgcaaaguagccuggacauugaucagcaguucgacgugaccgacuuugcucaggcccuggcgcguuucgcagaucaccaagcccucuccugggcuuuagaggcccccauccgcuuucuggaagcagagcuugcuacaggcuugucuaacucggccagagucgacgcggccauagaggcauucucauuugauacuaagguggacagggcugccaucaaagaaaugcugaagggccuaagcgggaaucagauugauuucaccaaacucuuuguaaacguugacagugcugauugggaccaggaggaacggaagcaauggaagaugaaacuguccgaggaggauuucgacgaacaggcccuuccuauccuggagcgauugucucaggaugaaacagaguucuuucucgcaauuaagcgcgccuacgacggaaucgcucugaugagauucuuaggugacgaacagagccuguccucagcgaugauaaaagcauaugaggaucauaggcgggaccucaccuuucuuaagacucaagugcgcacaccacagaauagacaggcccugagugagggcuacaccaacuauuugagcgucgaugacaaaaagcacaaaagaggggcuaaggaacuagcccagcugauugaggcaucugaugccuccgaacaagacaaggcuacgaugcucgaucguaucgccaaugaccaguucgcacccaaacagcggacuaaggcgaacggacugauuccuuaccagcuucaucuggcugaguugaaaaagauccucgccaaacaaggccaguauuacccauuucuguuagauaccuucgcaaagcagggucagucagugaauaagaucgaggagcuggugcaauuucgaguccccuacuauguugggccuauggugccaaaaagcgagacagccggaaacgcugaaaaccacuggguagagaagaaugacggccagacuaaagugagugucaccccguggaacuucgaucagguguuuaauagagacagggccgcaaagucuuucauugaucgccuaacaggcaccgacacguaccucauaggggaacccacucugccucggcacucccuuacauaugagaccuuuacuguuuugaacgaacugaauaacaucagaauugacggaaaaaggcucccaguggagacaaagcaagcuaucgucgaggaucuguucaagaaauaccgccuugugaccaagaaacgacugcaggacuauuuugccagcuucgguaagcgggaaguagaguugacgggccucgcggaugaaucgcguuucaccucuucccugacaucauaccaugacuuacaggggcugcuaggaacugauuuuauaaccaauccccagaaccacagucuccuggagaaaauuguugagauccaaacaguguucgaagacagcgauaucgccgagagagaacuuggcaaguugggucuggagcagaagcucauuccuaggcuggcuaaaaagcauuauacuggguggggcaauuuaucccgcaaacugcuugacaccucuuuuauccacgauccagaacggcccgaggagccggucagcauuauggacuugcucuacacaaccaacaagaauuucauggaaauacugcaugauucagaguacggaguggaagaguggcuaaaaagucagaacaugaucgacgaucagaaggacauucaaaugagaaucgacgaacugacuacguccccugcaaauaaaaggggcaucaagcaggccuuuaacguccucgaugacauuacacaggcuaugggggaggagcccgccuauguguaccuggaguucgcacgagaaaagcaggcgagccgccggaccguuucuaggaaaaagaggcuugaaacuuuguauaaaaaugccgcucugaagaccgaguuuaaagccauaaaggaagcauuagcugaggagucagaugaccguaugcaagaugaccgccucuaccuguauuacgcccagcuuggacgggauauguauacaggucagaguaucagcauugaccaacuguccucucacuacgauaucgaccacauugugccaagagcauucaucaaggaugacucguuggaaaacaaaguacucgucaacaggaccgacaaugcccgaaagacugauagcgcuacauuuacggcggacgugaaagccaaggcauucccucuguggcagcagcuaaagaagcugggccucauauccgcuaagaaauuucggcugcuuacccgcacuggggauuucacagagauggaaagagagagguuuaucgcccggcaguugguugagacccgacaaauuaucaagaacguggccgcucugauugaaggacauuucucacagacacaggcagucgccaucagagcggaggugacuggcgaauuacgccagcucacccaaauuaaaaaggacagggauauaaaugacuaccaccaugcucaggaugcccugcuuguagcaacggccgguaccuaucugcaccgucacuuccccaaacgggacgcuagauuuaucuacaacgaguucgauuauuacacacagcauuggcuaaagaaucagggggaaaacaggcgccgacacccauauaguuuugugguuggcacuaugucuaagggaaaugaggacuggacccccgauaaccucaauuaccugagaaaagucaugcaauauaagacaauguugaugacucggaaaccugugggcccagagggggcacuguacaaggaaaccuuaauugccgcggacccgaaaaagaggcucgugggagcuagcaaagagcgccaggaucccacgaucuacgguggcuauacaaaggaauccucagccuacaugagccugguccgugcagggggaaagaaccagcuuguuaaaauaccugugagaaucgccaaugagauucauucuggccagcggaagcuggacgacuaugugcaagcuaaaguaaagaaauucgaaaggaucuugcucccaaagauuucccugggucagcuagucgaggaugaggggcagcgcuuuuaccuggccaccaacgaaaugaagcacaaugcaaaacaacuuuggcucgaccagaaggugguuacuacauauaaacgacugaccgcugagagucccguggaagauuucuugacugucuuugacgcccugaccagcucugcgacaauccaucacuucaaguuuuaccagagagauuuagagcuccugcgggacaacagggccggcuuccaggaucuugcaaaagcuacgcaacugaagguguugaaggacguucucuaugaacugcacgauaaugccggauggcgcgacccuauaaaacaguacuuuaaggagauuggccuaaaagugagaauguggaccaagcugcagaaagaagggggaaucaaacuuacugaucaggcugaacucaucuaccaauccccaucaggccuguucgagaagaggcggcguguacaggacuuguuauga

SEQ ID NO: 2922 - RNA, 3939 nt, Artificial Sequence
  Cas9 variant
augcagaacggcuuccuggggaucaccgugagcuccgagcaagucggaugggccguuacaaaucccaaguacgaacucgagagagcuucuaggaaagaccuuuggggugugcggcuguuugauaaggcagaaacugccgaggaccgccgaauguuccguacgaacagaagguugaaucagcggaaaaagaaccgcauucacuauuuaagagauauauuucaugaagagguaaaucagaaagacccuaacuucuuucagcaacuggaugagucaaauuucugcgaagacgauaggaccguggaguuuaacuucgacacaaaucuauacaagaaccaguuuccaacugucuaucaccuccggaaguaccugauggaaaccaaagauaagccggacauccgccuuguguaucuggcguucaguaaauuuaugaagaaucgaggccauuucuuguacaaagggaaccucggagagguuauggauuuugagaauagcaugaagggcuucugugaaucccuggagaaguucaacauugacuuucccacacugucugaugaacaggugaaagaggucagagacauccucugcgaccacaagauugcuaaaaccgugaagaaaaagaauaucauaacuaucacaaaaguaaagucgaagaccgccaaagcauggauugguuuauucugugggugcucaguuccugugaagguccuguuucaggauaucgacgaagagauugugacggauccagagaaaaucagcuucgaagacgccaguuaugaugacuacauagcuaacauugagaagggagugggcaucuacuaugaagcaauugucuccgccaaaaugcuuuuugauuggucuaucaugaacgagaucuugggcgaccaucaacugcuaagcgaugcuaugauugccgaauacaauaagcaccacgacgaucucaagaggcugcagaaaauaaucaaggggacuggaucccgggagcuuuaucaggacauuuucaucaacgacguuucagguaauuacguguguuauguaggccaugcgaaaaccaugaguagcgcagaucagaagcaauuuuacacauuccugaaaaaccguuugaagaaugugaacgggauaucuuccgaggacgccgaauggauugauacugagaucaagaauggaacccuccugcccaaacagacaaagcgcgacaacucagucaucccucaccaguuacaacugagagaauuugagcucauucuugauaauaugcaggaaauguauccauuccugaaagagaacagggagaaguugcuaaaaaucuuuaauuucgugauucccuacuacguuggcccucugaagggugugguccggaagggggaaagcaccaacuggauggugccgaaaaaggacggaguaauacauccauggaauuuugaugagaugguugacaaagaagcuagugccgagugcuucaucucucgaaugacgggcaacuguuccuaucucuucaaugagaaggugcugcccaaaaacagccuucuguacgaaacuuuugaggucuugaacgaacucaauccucugaagauuaacggcgagccaaucucgguggaauuaaaacagcgcaucuaugagcagcuguuccuaacagggaagaaggucaccaaaaagucucucacuaaauaccugauuaagaauggauaugaugaggacauagaacuuuccgguaucgauaacgaguuucacucaaauuugaaaagucacauugacuucgaagauuacgacaaccugagcgacgaggaaguggagagaaucauucucaggaucacaguuuuugaggauaagcaacugcuuaaggacuaucugaaucgggaguucgugaaauuguccgaagaugaacgcaagcagauaugcucucucagcuacaaaggcugggggaaccugucagagauguuacugaauggaaucaccguaacggacaguaacggcgucgaaguguccguuauggauaugcuauggaauaccaaccucaaucugaugcagauucuuagcaagaaauacgguuauaaggcagagaucgagagauacaacaaggaacaugagaaaaauauuuauaacagggaagacuugauggauuaccugaacauacccccugcucagcgucggaaggugaaucaacucaucacaauugucaaaucucugaagaaacgauguggggugccaaacaagaucuuuuucaagguaucaagagagcaccaggacgaucccaaaaggaccaguagccgcaaggagcaguuaaaauaucuguacaagucccuuaaaucugaagacgagaagcauuugaugaaagaacucgaugagcugaauggccacgaacuaucgaacgacaagguguaucuguacuuucuccagaagggacggugcauuuacagcggcaaaaagcugaaucuuuccagauugaggaaaucaaacuaucaaaaugauaucgacuacauauauccgcugagugccguuaacgaccgcucuaugaauaacaaggucuuaacugggauccaggagaaucgagcggauaaauacacauauuucccuguggaccccgagauucagaagaagaugaaaggauuuuggauggaacucgugcugcaggguuucaugagcaaggagaaauacuuucggcuuucccgugaaaacgauuucucagagaaugaacuggucagcuucaucgagagagagauuucugacaaccaacaguccggcaggaugaucgccaguguuuugcaguauuacuuuccagaaagcaagauaguguucgugaaagagaagcucauuucuuccuuuaagcgcgauuuccaucugaucucaaguuacgggcacaaucaccuacaagcagcuaaagacgccuauaucacuauuguagucggaaacguguaccauaccaaguuuacaauggauccugcuaucuauuucaaaaaccacaagcggaaagacuacgaucugaauagacucuuucuggaaaacauuagcagggacggccagauagccugggagucgggucccuauggguccauccagaccguucgaaaggaauacgcacagaaucauauugccgugacuaagcgcgucguggagguuaaaggcggacuuuucaagcaaaugccauugaaaaagggccacggggaguauccccugaaaacgaacgauccucgguuuggaaauaucgcucaguacgguggcuacacaaacgugaccgggucuuauuucguauuagucgaaagcauggagaagggaaagaaaagaauuucacucgaauacgugccaguguaucugcacgagaggcuugaggacgacccgggccauaagcugcuaaaagaauaccucgucgaucaccguaagcugaaucaucccaaaaucuugcuggcgaagguucgcaaaaacaguuuacucaagauagacgguuuuuauuaccggcugaaugggagauccggcaacgcacuuauccugacuaaugccguggaguugauuauggaugacuggcagaccaagacagcuaacaaaaucucuggauauaugaagaggcgagccauugauaaaaaggcacggguauaccagaaugaguuccacauccaagaacucgaacagcuguacgacuucuaucuagauaaacuggagaacggcguguacaagaaucgcaagaacaaucaggccgagcuuauacauaacgaaaaagagcaguuuauggaacucaagaccgaggaccaauguguccuguugacugaaauuaaaaagcuguucgugugcagcccuaugcaggcugauuuaacacucaucgggggauccaaacacacgggcaugaucgccaugucaagcaacguuaccaaggcagacuuuaguauuauagcggaggauccacugggucuuagaaauaaggugaucuauucucacaugggggagaaauga

SEQ ID NO: 2923 - RNA, 3939 nt, Artificial Sequence
  Cas9 variant
augcagaacggcuuccuggggaucaccgugagcuccgagcaagucggaugggccguuacaaaucccaaguacgaacucgagagagcuucuaggaaagaccuuuggggugugcggcuguuugauaaggcagaaacugccgaggaccgccgaauguuccguacgaacagaagguugaaucagcggaaaaagaaccgcauucacuauuuaagagauauauuucaugaagagguaaaucagaaagacccuaacuucuuucagcaacuggaugagucaaauuucugcgaagacgauaggaccguggaguuuaacuucgacacaaaucuauacaagaaccaguuuccaacugucuaucaccuccggaaguaccugauggaaaccaaagauaagccggacauccgccuuguguaucuggcguucaguaaauuuaugaagaaucgaggccauuucuuguacaaagggaaccucggagagguuauggauuuugagaauagcaugaagggcuucugugaaucccuggagaaguucaacauugacuuucccacacugucugaugaacaggugaaagaggucagagacauccucugcgaccacaagauugcuaaaaccgugaagaaaaagaauaucauaacuaucacaaaaguaaagucgaagaccgccaaagcauggauugguuuauucugugggugcucaguuccugugaagguccuguuucaggauaucgacgaagagauugugacggauccagagaaaaucagcuucgaagacgccaguuaugaugacuacauagcuaacauugagaagggagugggcaucuacuaugaagcaauugucuccgccaaaaugcuuuuugauuggucuaucuugaacgagauccugggcgaccaucaacuacucagcgaugcuaugauugccgaauacaauaagcaccacgacgaucugaagaggcuucagaaaauaaucaaggggacuggaucccgggagcuguaucaggacauuuucaucaacgacguuucagguaauuacguguguuauguaggccaugcgaaaaccaugaguagcgcagaucagaagcaauuuuacacauucuugaaaaaccgucucaagaaugugaacgggauaucuuccgaggacgccgaauggauugauacugagaucaagaauggaacccuguuacccaaacagacaaagcgcgacaacucagucaucccucaccagcugcaacucagagaauuugagcuuauucuggauaauaugcaggaaauguauccauucuugaaagagaacagggagaagcuacugaaaaucuuuaauuucgugauucccuacuacguuggcccucucaagggugugguccggaagggggaaagcaccaacuggauggugccaaagaaggacggaguaauacauccguggaauuuugaugagaugguugacaaagaagcuagugccgagugcuucaucucucgaaugacgggcaacuguuccuaucuguucaaugagaaggugcuucccaaaaacagccuguuguacgaaacuuuugagguccucaacgaacugaauccuuuaaagauuaacggcgagucgaucucuguggaacugaaacagcgcaucuaugagcagcuauuccucacagggaagaaggucaccaaaaagucccugacuaaauaccuuauuaagaauggauaugauaaagacauagaguugucagguaucgauaacgaauuucacaguaauuuaaagagccacauugacuucgaggauuacgacaaccucuccgacgaagagguggaacaaaucauucugagaaucacaguuuuugaggauaagcagcuucugaaagacuauuugaauagggaguucgugaagcucucugaagaugagcggaaacagauaugcagccugucauacaagggcugggggaacuuaagugaaaugcugcuaaauggaaucaccguaacggacuccaacggcgucgaggugagcguuauggauaugcucuggaauaccaaccugaaucuuaugcagauuuugucuaaaaaguacgguuauaaggcagaaaucgagcauuacaacaaagagcacgaaaagacaauuuauaaucgcgaggaccugauggauuaccucaacaucccacccgcucaaagaaggaaagugaaccagcugauaacuauugucaagucacugaaaaagaccuauggggugccuaauaagaucuuuuucaaaguaagucgugaacaucaggacgauccaaagcggacaagcucccgaaaagagcagcugaaguaccuuuauaaaucuuugaagucggaggacgaaaaacaccucaugaaggagcuggaugaacuaaacggccaugagcugagcaaugacaagguguaccucuacuuucugcaaaaaggaagauguauuuauuccggcaagaaacuuaacuugucaaggcugcgcaagaguaauuaccagaacgauaucgacuauauauaccccuuaucugccguuaaugaccggagcaugaacaauaaaguccucacugggauccaggaaaacagagcggauaaguauaccuacuucccgguggacccugagauucagaagaaaaugaagggauuuuggauggagcuggugcuucaagguuucauguccaaagaaaaguauuuuaggcugucacgcgagaaugauuucagcgaaaacgaguuggucucuuucaucgaacgagagauuuccgacaaucagcagaguggccggaugaucgccagcguucuccaauacuacuuucccgagucuaaaauaguguucgugaaggaaaagcugauuuccucauuuaaacgugauuuccaccuaaucaguagcuaugggcacaaccaucugcaggcagcuaaggacgccuacaucacaauuguagucggaaauguguaucacgcuaaauuuaccauggauccagccaucuacuucaagaaccauaaaagaaaggacuaugaucucaacaggcuguuucuugagaauauuucgcgcgacggccagauagcaugggaauccgguccuuacgggucuauccagacuguucggaaggaguaugcccaaaaccacauugcugugacgaaaagagucguggaaguuaagggcggauuguucaaacagaugccccugaagaaaggccacggggaguacccauuaaagacaaaugaucccagguuuggaaacaucgcgcaguacgguggcuauaccaaugugacugggagcuacuucguacucgucgagucaauggaaaagggcaaaaagcgaauuagucuggaguaugugccuguguaccuucaugaacgccuggaggacgacccaggacacaaacuacucaaggaguaucuggucgaucaucggaaauugaaccacccgaagauccuguuagcaaaaguuagaaagaacucccuccugaagauagacgguuuuuacuauaggcuuaaugggcguucuggcaaugcccugaucuugaccaacgcuguggaacucauuauggaugacuggcagacaaaaaccgccaauaagaucagcggauacaugaaacgccgggcaauugauaagaaagccagaguauaccaaaacgaguuccauauccaggaacuggagcagcuauaugacuucuaccuggauaaacuugaaaauggcguguauaagaacaggaaaaauaaccaggcugagcucauacacaaugagaaggaacaauuuauggagcugaaaacugaagaccagugcgucuugcugacagagauuaagaaauuauucguguguucccccaugcaggccgaucucacgcugaucgggggaucaaagcacaccggcaugaucgcaaugagcaguaacguuacuaaggcggacuuugcugugauugccgaagauccucuuggucugcgaaacaaagucauauacucucauaugggggagaaguga

SEQ ID NO: 2924 - RNA, 3942 nt, Artificial Sequence
  Cas9 variant
augcacuaccuggacgagaucuucgcuccccaucuccaggaaguggaugagaacuuucuuagaaggcugaagcaaagcaauauucacccugaagacccagccaaaaaccaggcauucauaggcaaguuguuauuuccggaucugcuaaagaagaaugagcggggguaucccacccucaucaaaaugcgcgacgaacugccugucgagcagcgagcccauuacccaguuacaaacauuuauaaacuucgugaggcgaugaucaaugaagauagacaguucgaccugagggagguguacuuggcuguacaccauauuaugaaguaucggggacacuuucucaacaaugccuccguggauaaauucaaggucggucgcaucgacuuuuacaaaucuuucaacgugcugaaugaagcauaugaggagcugcaaaacggcgaagggucauuuacuauagagcccaguaagguugaaaagaucggacagcucuuacuggauacgaagaugagaaaacuuaauaggcagaaagccguggcuaaguugcuggaggucaaaguggcagacaaggaagagaccaaacggaacaagcagauugccacagcuaugagcaagcuaguacucggcuacaaggccgauuucgcgacuguugcaauggccaaugguaacgaguggaagaucgaccuguccucugaaaccucggaggaugaaauugagaaauuucgcgaggaacuuucagacgcucaaaaugacauccugacagagauaaccagcuuguucagucagauuaugcucaacgaaaucgugccuaacgggauguccauuucugagagcaugauggaucgauacuggacucacgaaagacagcuggccgaggucaaggaauauuuagcaacacagccagcuuccgccaggaaagaguuugaccaaguguacaauaaguauaucggacaggcgcccaaagagcggggcuucgaucuggaaaagggccucaagaaaauccuuucaaagaaagagaacuggaaggaaauugacgagcuguugaaagccggggauuuccuaccuaagcagcguaccagugcaaauggagugauaccacaucaaaugcaccagcaggagcuggaccgcaucauugaaaagcaggcuaaauacuauccguggcucgccacggagaaccccgcuacuggugaaagagauaggcaucaagccaaguacgagcuggaccagcuugucagcuuucggaucccuuauuacguuggcccacuggugacccccgaaguacagaaagcaacaucuggggccaaguucgcuugggcgaaacgaaaggaggauggagagauaacuccuuggaauuugugggacaagauugaucgcgcagaauccgccgaggcuuuuaucaaaagaaugaccgugaaggacacauaccuccugaacgaagacgucuuaccagccaauucacugcuauaucagaaauacaacgugcucaaugagcugaacaauguuagggugaacggccggcgccuuagcgucgguaucaagcaagauauuuauaccgaauuguucaaaaagaaaaagacggugaagguaagugacguugcaucucuggugauggccaaaacuagaggggucaauaagcccuccguggagggacucagcgauccgaaaaaguuuaacucgaaucuggcuacauaccuugaccugaaaucuaucgucggcgauaagguggacgauaacagguaucagaccgacuuggagaacauuauagaauggcguuccguuuucgaggauggcgaaaucuuugccgacaagcucacugagguggaauggcugacagaucagcagcggucagcauuagucaaaaagcgauacaaaggguggggaagacugaguaagaaacuacucaccgguauuguagacgagaauggccaaaggaucaucgaucugauguggaacacggaccagaauuucaugcagauugugaaccagccuguuuuuaaggagcaaauagaccagcuuaaucagaaggcgaucaccaacgaugggaugacauugcgcgaauggguggagagcguccuggacggagcuuauacuucuccccaaaauaaaaaggccauuuggcaagugguacgggugguugaagauaucgucaaagcagugggcaacgccccaaaguccauuagcaucgaguucgcuagaaaugaggguaacaaaggggaaauaaccaggucacgccgaacacagcuccagaagcuguuugaggaccaggcccacgaauuagugaaggauaccagucugacugaggaacuugagaaagcaccugacuuguccgaucgguacuaccucuauuucacacagggcggaaaggacauguacaccggcgaucccaucaauuuugacgagauuagcacuaaauaugauaucgaccacauucugccacagucuuucgucaaggaugacucacuagacaaccguguucuggugaguagagcugaaaauaacaaaaagagcgauagggugcccgccaaacucuacgcggccaagaugaagccuuauuggaaucagcugcuuaaacaaggguugaucacgcagcgcaaguucgagaaccugacaauggacguagaucagaacauaaaauaccgguccuuaggauuugucaagagacagcucguggaaaccaggcaaguuauuaaacugacugcuaauauccuugguucuauguaucaggaggcaggcaccgacauuaucgaaacacgagccgggcugaccaagcaguugcgcgaggaguucgaucucccaaaggugcgggaagucaacgacuaccaucacgcuguggaugccuaccugacuacauuugcaggacaauaucuaaauagaagguacccgaaacugcguucguucuuuguuuauggcgaguacaugaaguucaaacaugguagcgaccucaagcugcgcaacuuuaauuucuuucacgaacuuauggagggggauaaaucccagggcaaggugguagaccagcagacgggagaauugauaaccacucgggaugaggucgcgaagucauucgacagacuguuaaacaugaaauauaugcucgugaguaaggaggugcaugacaggucugaucaacuguacggcgccacaaucgucaccgcuaaagaaagcgggaaacuuacaucccccauugagaucaaaaagaagcgaccuguugaccuguauggagccuacacuaaugguaccucagcauuuaugacgauuaucaaauucaccggcaacaagccaaaauacaaggugauagggguacccacaacuagcgcugugggacuaaaacgggucggcaagccugguucugaauccuauaaucaggagcuccaccgcauuaucaagaguaacccaaaagugaagaaagauuuugagaucguugugccccacgucagcuacucucagcugauuguggacgaugacugcaaguucaccuuggccuccgauacauaucagcauccggcaacucaacugguuuuaucaaaagaaaguauggagaucauugccgacgauuucaaguuugugaaagaaaauaccgcuacggcggacgagcagcucgucagaguauucgaugaaauagugaaccagaugaaucacuacuuuacaaucuucgaccagaggagcaaccggcaaaagguuaccaaggcccgagauaaauuugugucgcugccuacugaguccgaguaugaaggggcaaagaaaacacaggucggcaagaccgaggugauuacuaaucuucugaugggauugcaugcuaacucugcccagggcgaccucaaaguacuggggcuaagcaccuucggauuuuuccagucaaguggcggucugaaccuuuccgaagacgccaugaucguguaccaaucuccaacagggcucuuugagagacgcauuugucugaaggauaucuga

SEQ ID NO: 2925 - RNA, 3942 nt, Artificial Sequence
  Cas9 variant
augagcuucaaggagaacuccaaaaucuacuauggccuggacauugggaccgauucugugggauggucaacaacuaaugaaaaguacgagcuccuuagauauaaaaacaaucugauguggggugucaguuuguuugaagccgcuagcuuagcagaggaaaggcggggccaccgcacgcagcgacguagauacgacaggcggcaacagcgcguugcccugcuaggggaacucuucgcgaaggagauacugaaaaccgaucccgacuuuuuccuuagacugaaggaauccucuuuguauccugaggauaggacaucgaagaacgugaauacuuacuuugacgaugcugacuucaaagauucagacuauuuuaagauguacccaaccguacaucaccucaucaaagaacugagcgagaguaacaagccgcaugaugugcggcuggucuaccucgccugcgcauucauuguggcccaccgcggacacuuuuuaaauggcgcugacgagaacaauguucaggcagugcuggauuucgacuccucuuauugugaauuuacagacugguucaaaagcaacgauaucgaggacaaucccuuuuccgaaucagucaagaacgaguucagugugauucuucgaaagaaaaucgguauaaccgccaaggaaagagagaucaaaaauuugcuguucgggacuacaaagaccccugauugcuacaaagacgaggaauauccaauugauaucgacguacuaauuaaguuuaucagcggaggcaaaacgaaccucgcuaagcuguucaggaaucccucuuacgaugagcuugacauacagacuguugaagugggcaaggccgauuuugcggacaccauugaucuguuggcauccucaauggaggacacagacgucccucuccugagcgccgugaaagcuauguaugauuggaguuuacugaucgacgugcucaaggggcagaaaacuauuucugaugccaaggucugugaauacgagcagcauaaauccgaccuuaaggcacugaaguauaucguucggaaauacuuggaucgugcucaguacgacgagaucuuccgcaccgccggagaaaagccaaacuaugugagcuacucguauaacguaacagaugugaaacuaaagcagcugcccucuaauuuuaaaaagaagaacuccgaggaguucugcaaauacauuaagucaaaacucgagaagauaaaaccugaaagugacgaugaggcggucuauaaugagcugaucgaaaaguguaacagcaagacccuuugcccaaaacaagugacggacgagaauagaguuauuccguaccagcuguauuaccacgaauuguccaugauccucgauaaggccucugcauaccuggacuuuuuaaacaaaacugaggaugguauaagcgugaagcagaaaauucugacacuaaugaaguucaggauccccuauuuugucggcccucucgugaaacggaaugagaccgacaacguauggaucguucgaaaggcugaagggcgcauuuacccauggaauuucgagaacaugguggacuuugauaagucagaagacggauucaucagaaggaugacuuguaaaugcacauaucuggccggcgaggauguccuucccaaguacaguuugcuguauuccaaauacaccgugcucaaugaaauuaacaauauaaaggucaacggugagaaaaucagcccugagcugaagcaggacauuuuuaaugaacuuuucaugaagacgucucgggugaccguuaaaaagaucacagagcuguugaaacgcaagggggcuuucucagaagagaaaggagauagucucagcggcguggacaucaacauuaaguccucucugaagucguauuuagauuuuagaaggcugcuagaaaacggcagccucuccgagaaugacguagagcguauaaucgaacggauuacugucaccacagauaaaccacgacuggugucauggcuuaaggccgaguacagugacuugcccgcagaagauaucagauacauuucuaggcugagcuauaaagacuacgggcgccucuccgccaagcuguuaacuggauguuaugagcuggauaccaacacaggugaaaucggcgggcggucaauaaucgacuucaugugggcugagaauauuaaccuuaugcaaaucuugagcgacucuuacggauauaaauccuuuauugaggaagagaauaagaaguacuauaugaucaacccgaccggcaguauagcgcagacucucagagaaauguacguuagcccuucuguguccagggcaauuauccgcacgauggagauugucaaagagcugcgaaagaucaccaaaaaggaucccgacaaaauauucguggaaauggcccggggugggaagccagaggaaaaaggcaagcguacaucaaguagaagggagcagaucgaaaagcuauacgauagcgcuaaagccuuuguaucggacgaggauauuucccauaugcgcucucaacugggaagccucucagacgagcagcugcggagagaaaaguauuaccuuuauuucauccaguuuggcaaaugcauguacaguggggaggcaauugauuucuccagguugggagacaaucacuguuaugauaucgaccauauauuuccucagucuaagauuaacgaugacagccugcacaauaaaguguuaguuaagucccaacucaacggugaaaagucagacgauuaccccaucaaagccgagauccgaaauaagaugcacccacuguggaaaaaccuuuucuaucgcgaccccaagaauccugcugauaaagucaaguacgaacggcugacuagaagcaccccauuuacagaggacgaguuggccggcuucauugaaaggcagcucguggagacccgucagaguacuaaggcaguggcgacacugcuaaaagaaauguuuccggauucuaagaucgucuacguuaaagcugggcaaguguccgaguuccgccaugacuucgauaugcugaagugccgggaaauuaacgaccuccaccaugccaaagaugcauaucugaauauagugaucggaaacguacacgacgucaaguuuacgagcaaccccaugaauuucgugaagaacgccgauaaacauuacaccauuaagguuaaagagacucuuaagcacaaagugucgagaaauggcgagacagcuuggaacccugaaaccgacuuugauacagucaagaggaugaugucaaagaacucugugcgauauguucgguacugcuauaaacgcaaggguggguucuuuaaucaaaauccagacagagccggcaaccccgacuuggcaaggcugaaaaaggauuuagacccugugaaauacggaggcuauaauaguaaguccaucagcuguuucucucucauuaaaugcacugggguaggagcugucaucauaccaguggagcugcuuugugaaaagcgguacuuuagcgaugacuccuucgccucagaguacgcguauagugugcugaagaacgcccuacccgcuaaaaauaucgcaaagauuagcaucgaugacauuucuuuuccgcucaaacgaagaccuaucaagauaaacacccuguucgaguuugaugguuaccgcgucaauauuagguccaaagacucauaucacuacuucacgaucaguagcgccauggcugccaucuauuccaaggauaccucugacuacauuaaggcaguuucgagcuauauagauaaaucagacaagggcuccaaauucaagccaggggaagcguuugauguguugaguaaccugaaaguauacgacgagaucgccaagaagugcauuucugaacccuucagcaaaaucuccaaguuagcugaggccggaaaacguuggaagaaagaagagauuucacuccagaauugucugcuuuga

SEQ ID NO: 2926 - RNA, 3945 nt, Artificial Sequence
  Cas9 variant
augcugaagaaagacuacagcaucggccucgauauugggaccaacuccgugggacacgccgucguuacagacgauuauaaggugcccacuaaaaagaugaaaguauucggugacacgucuaagaagaccauaaagaagaauaugcuuggcgugcuguuguuuaacgaggggcagacagcugcagauacuagauuaaaaaggggagcccggcgccgauacacccguagaaagaauaggcugcgguaucuacaagaaaucuucgcgccugcucucgccaaagucgacccaaacuuuuucuaccgccuggaggaaucaagucuuguggcagaggauaagaaguaugacguuuacccgauuuuuggcaaaagagaagaggagcuguuguaucaugauacacacaagaccaucuaccaucucaggagcgaacuggccaauaacgaccggcccgcugaucugcgccucguguacuuagcacuggcccacauuaucaaauaucgagguaauuuccuuuuggagggggaaauagaccugagaacuacagauaucaacaaggucuuugcugaguucuccgagacccuaaaugaaaacucugacgagaaucucggaaaacuggacguggccgauauuuuuaaggacaacacguucucgaaaacuaagaagucagaggaacuucugaaauugagcggcgcgaagaaaaaucagcucgcacaucagcuguuuaagaugaugguaggcaacauggggaguuucaaaaagguuuuaggaaccgaugaggaacacaagcuguccuuugguaaagacacauacgaggaugaccucaaugaucuucuggccgaagcuggcgaccaguauuuggauaucuucguggccgcaaagaaagucuacgacgcugccauucuagcgucuauccuggaugugaaggacacucaaaccaaaacaguguucagccaggccaugauagagagguaugaggaacaccagaaggaccucauugaacugaagcgggucuuuaaaaaguaccuuccugagaaaugccaugauuucuuuuccgagccaaagaucucaggguaugcaggauacauugacggcaaaguuagugaagaggauuucuacaaguauaccaagaaaacgcugaaggguauccccgaaacugaggaaaucuugcagaaaauugacgcuaacaacuaccuccguaagcaacgcacauuugauaauggggccauaccucaccaggugcaucugaaagaguuaguagcuaucguggagaaccagggaaaguauuacccauuccugagagaaaauaaagacaaguuugagaagauucuaaacuucaggauccccuauuacgucggcccucucgcccggggcaauagcaaauuugcauggcugacccgagccggggaaggaaagauaacuccauauaacuucgaugagaugauugacaaagagacaucugcugaagauuuuaucaagcgcaugaccaucaaugaccuuuacuugccgacggagcccgugcugccuaaacacucccuccuguacgaaagauauaccauuuucaacgagcuugcggguguuagguacgugacagaaaauggcgaggcaaaguauuuugaugcccagacuaagcggucaaucuucgagcuguucaaauuggaccgcaaggucagcgagaaaauggugauuaagcaccucaaaguaguuaugccagcuauaagaauccaagcccugaagggguuagauaacggaaaguuuaaugcaaguuacggcaccuauaaagaccugguggacaugggugucgcccccgaacuacucaacgaugaagucaauucugagaagugggaagacauuaucaaaacacugacuaucuucgaggggaggaaacuuauuaaacgucgguuggagaacuaccgagauuuucugggcgaagacauacucagaaagcuguccaggaagaaauauaccggauggggccgcuuaagcgcuaagcugcuugaugggaucuacgacaaaaagacacauaaaaccauuuuggauugucucaugacugaggacuacucgcagaauuucaugcagcugaucaacgaugacacguauucuuuuaaggaaacaauuaaaaacgcccaagugaucgagaaggaagagacccuagcaaagacugugcaggagcugccuggauccccagcgaucaaaaaggguauacuccagucacuggaaauuguugaugagaucauuaaagugaugggcuacaagcccaaaaguaucguagucgaaauggcucgggagacccagaagacacacgggaccagaaagagggaggaccgcgugcaacagauaguuaaaaaucuuaaggaugccaacgaauugccgaaaaagcugccuagcaaugcagaguuauccgacgaacgaaaauaucucuacugccugcagaacggacgggacauguauacuggcgcccccuuggauuacgaccaucugcaguucuaugauguggaccacauuaucccacaaucuuuucuuaaggaugacagcauugagaauaagguccucacaaucaaaaaggaaaacgugcguaaaacgaauggucugccuucagaggcuguaauacagaagauggggaguuucuggaaaaagcuacuggaugccggcgcaaugaccaacaagaaauacgacaaucucagaaggaaccugcauggaggccuuaaugagaaguugaaagaacgcuuuaucgagcggcagcugguggaaacuagacagauuacaaaguacguugcucaauuacucgaucagaggcugaacuaugacgggaauggagucgagcuugaugagaaaaucgccauugugacccugaaggcgcagcuagccucccaguuccgaagcgaauuuaagcuccgcaaagugcgggcucugaacaauuugcaccacgcacaugacgccuaccugaacgcugucguugccaacuuaaucauggcaaaguaucccgagcucgaaccagaguucguguacgguaaauauagaaagacaaaauuuaagggccuggggaaagcgacugccaagaauacccuuuacgcuaacgugcuguauuucuugaaggaaaaugagguauaccccuucugggacaaagccagggaucucccuacgauaaagcguuaccuguaucgcgcacaagucaacaaagugcggaaggcugaaagacagaccggaggcuuuucugacgagaugcuaguuccaaaaucagauagugguaagcugcuuccgaggaaggaggggcucgaccccgugaaauacggcggauaugccaaggcagucgaaagcuacgccgugcugauuacagcugaugagguuaaaaagggcaaaacuaagaaggugaaaaccuugguaaauaucccuaucauugacuccaagaaauaugaagcggauccaacagccuaccuggcaucucgaggguauacuaacgucaccaauucguucaucuuacccaaguacagccuccuggaggacccugagggacggcgcagauaccuugcuuccuuuaaagaguuccagaaggccaacgaacugauuuugccacaacaccucguggaacugcuauauugggugaaugccaaggauggcgagcagaaacuggaagaccauaaggcugaguuuaaagagcuuuucgauaagauaauggaauuugcagacaaauacgucguugcccccaagaacucagagaaaaucaggcggcucuaugaagagaaucaggaugcgacgccgauggaacuggguaagaacuucguggaguuguuacgauacacagcugacggggccgcaagugacuuuaaguucuuuggagagaauauuccuagaaaacgcuauaacucugccggcagccugcucaaugguacccugaucuaccaguccaagacuggccuuuaugaaacaaggauugaucuggggaaauuguga

SEQ ID NO: 2927 - RNA, 3948 nt, Artificial Sequence
  Cas9 variant
augggcuacagcguggggcuggacaucggaaccgguuccgucggcuggguugugacaaacgaggaugggaagcucgccagagcuaaaggaaagaaucuuauuggcguaaggcuguucaaaacugcagaacccgccgcggaccggcgcacgaaccgaaccacacguagaagguugucucggcgcaaguggagauuaaggcugcuagaugagcucuuugcuaaugaacuggguaaaauagacucaaacuuccuuacucggcugaaguauaguuacgugcacccuaaggaugacgccaaucgcgcaaacuauuacgggggauauuuguuuccaacccaggaggaaacuaaaaaguuccaugccaaauacccgaccaucuaucaccuccgacuggcucugaugacugagagcagacaauuugaucucagggagauuuacuuagcaaugcaucagaucgucaaguaccggggccacuuccuaaauucccagucuaaaaugacaauuggcaacaccuauaauccccaggaccuucaaacggccauggaaaacuacgcugaggccaagggguugucgaucgaacugaagcagccugaggagaugguggcgauacuaacuggagaagcagguuuuggccucagcaaaaaggccaaagcugagaagcugcuuaauaacuucuuuuucgauaccaaagaagagaaggccacaguucaggcaauccuggcugggauugugggaaauacuaucgacuuuaccaaagucuucaaccgucaguugacaggcgauacccucaaggccuggaagcugaaauuagacagcgaaacguuugauguggacagugagccaauucuguccgaccucgaugacgaugagacugaacuuuucuucgcgauccgccaagccuuugacgguuucacacugaugaauuugcuaggggaucagaccucuauaagcgcagcuaugguagagagauauacucagcaucacgacgaucugcucacaguuaaacagguggccaaaaagcaaggacugucccacaaagaauuuucaaacauuuacagugcuuuccuuaaggacgauaccgacaagggcaugaaaaagcuguuggaggaaagcaaccucucuacggaggaugucaauggcauccagcugaggauggacucccaugacuuuuuaccccagcaacggaccaaagccaacucagugauuccucaccagcugcaucuagcagagcucgaagccaucaucgagaaucaggggcaguauuacccauuccugcuugaaacauuugagaaggaaggaacugcugcgaacaaaauugcagaguugcugaaguuccgaauacccuauuacguggguccuauggucaccaagaaagauguugagaaugccggcggggacgcuacaaaccacugggugacucgcaaugaaggauacgaaaagagcgccguaaccgcauggaacuuugaucaaguguucaauagagaccaggccgcucucgauuuuauccagaggcugacaggcaccgacacuuaucuuauuggugaaccaacgcugccgcagaacaguuugaaauaccaaauguucacaguccucaaugagcugaacaaugugaagguuaacgggcggcgcaucgauaaucagaccaaacacgacuuaauacaggaucuguuuaagucuaagaaaacugugucccuaaaggccuuccaggacuauuaccaaagccagggcaaaucggauauucaggucgugggacucgcagacaagaccaaauucaacucuaaccuguccacauauaucgaucuuucaaagaccuuuagugcggaggaaauggagaauccccagaaccaagacuugcuggaacagaucguagagauucagacuguuuucgaagacagcaaaaucgcugagagagagcucuccaagcuggaauuaacaccugagcaagugacgaagcuggccaaaacccauuacacuggcugggggaaucuuucuaacaaguugcucacaaccccaauugucgaugugagcggaaagaaggucucaauacuggaccagcuagcaaaaacaaguaagaauuuuauguccaucauuagcaacgaacaguauggugugcaggauuggaucaaggagcaaaauacuaccgaaacgaccggcacacuggaggacaaacucgccgaucugacuaccucucccgcuaacaagagggggaucaaacaggccuucaauguucuuuuugacauucagaaggcaaugaaaucagagccugaucguguguacuuggaguucgcucgggagacacagacaaguguacgaaccaugagcagauacaacuaucugaagggauuauaccaauccaagucucucgacgccgaagcgaaaaaucugaagaaagagcuugccgaaacggaucagaagaaauuugacaacgauaggcuguauuuguacuuccagcagcaaggcaaggacauguauacaggucagccaauaaauaucgauaagcucucgagcgacuacgacauugaucacaucauuccccaggcuuuuaccaaagacgauuccaucgacaaccgcguccuggugucacggccggagaaugcaagaaagagugauucugggacuuauacaaccgagguucaagccgcugccagcggccuauggaaaacucuggugcaguccggauucauaucaaggaagaaauacgaccgccucacccaugcaggcgauuacagcgaagggcagaagacaggauuuaucgcgcgacagcuggucgagacgcggcaaauuaucaaaaacguggccgcucuuauugaaucugaguucgaccagacccaggccguagcaauccgugcugagauaacuggugauaugagaagguugguggccauuaagaagcaccgcgaaaucaacuccuuucaucacgcauucgacgcccuguuaauuacagcugcgggccaguauaugcaaaaacgguacccugauagagacaguaauaacguuuauaaugaguucgacagguacaccaacgauuaucucaagaaacugcgagaaucaucuuccaaggacgagguccgcaaacuuaagcccuuuggguucaucgugggaacaauggccaagggcaaugaagauuggacuaccgagcagacggaguaccugcggcacauaaugaacuuuaaaaauauccuaacaaccuauaagacugguccagacagagggccucucucaaaagaaaccauuuacgcaguggaucccaaggcuaaacugaucggcacaaacaagcauaggcaggacgucaguuuguacggaggcuauacuuacccauauagcgccuacaugacccugguucgugccaaugggaagaaccaguuagugaaagugucgcgcuccgcugcaucucucaugaaaagcggacaacugaaacuugaggauuauguacagcagcagcccgaagucaagaaauucgagaagauucuguuggaacaccucccucugggccaacugguggacaaugaugguaagcugauguaccuuacaucauaugaguuuuaccauaacgccaaacagcucuggcugaguacggagaaugcggacuugaucuccucucugagcauagauuccgacgaucagaaguuaauuaaggcuuucgacauccucaccgccgacucaguuaucgaacgguuuccauucuacgagauugaucugaagaaacuuaucgaacugagagacaaguuuguguugauugauaacaagcucgacguccugagggugguucuaaaagcacugcaacuugauagcgcccagcagaagccgcucaaacugauagacaaggcugcaacugauuggaaaaauuaucgacaggccgggggaaucaaguugagugacaacgcggagauuaucuaccaaucuacaaccggcauuuucgaaaaacggaucaagauauccgauuuacuguga

SEQ ID NO: 2928 - RNA, 3951 nt, Artificial Sequence
  Cas9 variant
augcugcagaagaacuacaccaucggccucgacauugggacaaauagcgugggauaugccgucauaaacgauaauuacaaaguucccgcuaagaaaaugaaggugcuugguaacacugacaaaaagacgaucaagaaaaaucugaugggcguauuguuauucgaugcaggggagaccgccgcgacaacuagacugaagaggggaacccggcgccgauauacacguagaaggaaccggcuacgcuaccuccaagaaauucugggcccugagcuugcuaaaguggacgccaauuuucugcacagauuggcagaauccucucucgucaccgaggauaaggaauuuucagccuauccaaucuuuggugacagggaggaggaacugcuguaccauaaaacuuauaagacaauuuaccaccuccggagugcuuuagcaaacaaggaugagaaagccgaccugcgccuuaucuacuuggcucuggcccauauaaucaaguaucgagggaauuuccuaauugaaggagagaucgagcucagcgauaccgacauugauaaaguguacgcggacuuuugcagauccuucaacgaacuguuugauacggagguucuucaggaaaucgagguggaagcaauauucaaggacaaaacucugucuaagaccaaaaaggccgaggaguuggucaaggugucgggcguaaagaagaaucagguugcucaccaguuucucaaaaugauggugggcaacacagucaauuucaagaaaguguuuaaccugacugaagaccaaaaguuaucauucgggaccgauagcuaugaggacgaacugaaugaucuccuugccaagagugacgauagguaccuggacguguuugucgcagcuaaaaagguuuaugauacagccauuuuggcgaacauccuaaacaccaaaaauuccguggccacgaagacuauuuucucucagagcaugaucgagcgguucaaagaccaucagaaggaucugaaggaacucaaacagcuguuuaagacauaccuuccggagaaauaucccgacuucuuuggaaacuccaaggaggaugguuacgcaggcuacaucgaagggaaaaccaaugaggaaaaguucuauacucacacaaagaaaauucugaagaacauaccucaagcugccucaguauuggcucagaucgacgugggaaauuaccuccguaaacagcgcaccuuugacaacggcgucauuccacaccagauccaacugaaggaguuacuggccauaauugaaaaucaggguaaauauuaccccuuccuacucgagaacaaggagaaaaucgcaaagauccugacguuuaggauuccuuauuacguggggccacuugccagaggaaauagucgguucgcuugguugaagcgaguuggcaaagaaaagaucacccccuuuaacuucgagaauguggucgaucuggaaagcucugcggagcgcuuuauugagagaaugacacucaacgaccuguaucuuccugaagagaaagugcugccaaagcauuccauguuguacgaaaaauucucaauauuuaaugagcucgcaggcaucagguacauuacugauaacggggaaaugaaguuccuggacgcccagaccaagcaaagcaucuucgaguuauuuaaacaggagcggacaguaaaggaaaagaagguucuggaucuacucaaaacucugaugccgagugagcgcguggucgcuaucaagggaauugacaaugguaaguucaacgccucuuuuggcaccuaucacgaucuuuccaaaaugggguucaagacagagaaaauagcaagcgaaucgaaccaggccagaugggaagagaucauuaagaccuugacuaucuuugaggacaggaaacugauuaagucucgucuccggaaguacgaugacuuccugaaugaaaaagagaucggagcuuuauccaagcgaaaauauacgggcugggguagacugucagccaaacuuauagaugggaucuacgacaaaaagacacaucagaccauuuuggauuuucucaugaacgaagacuauaaucaaaacuucaugcagcugaucaguaaugacaacuacagcuuuaaaaagauuaucgaggauucccaggugauaaaggaagagggcucucuaacugaggucauucaggaacugcccggaagcccugcaaucaaaaagggcauucuccaaucaaucgagauaguggacgaacugguuaaagugaugggagggaauccaaagaaaaucguagucgagauggcgagggagacccagaagacacacgguaccacucgccgggaagcuagaauuaaggagaucauuaaaaaccuuaauaaguugaaacugaacgaauuacccaaggaucucccuaguaaugaggaacuguccgacgagaaaguguaucuuuacugucugcagaacggcagggauauguacacaggggccccauuggaccucgauaaucugagccaguaugagguugaccacaucauaccccaaucuuuccuaaaggaugacucaauugaaaacaaggugcugacggcaaaaaucgagaauagucgcaagaccaacggacucccgagcgucgaaaucgccaaaaagaugggcgcuuuuuggcgaucccugcuuaaagugggugccauuucugagaagaaguaccggaacuugcguagaucgcugcaugggggcaugacugaaaaauuaaaggagacauucguaaaaaggcagcucguggagacccgccagaucacaaaguauguugcacagauucugaauagccgguuuaacgaagagaaaaaugaagauaaggucgcuauagugacucuuaaggcccaacugaccucccaguucagaaaagacuucgagcuauacaaggugagggaaaucaacaaucuccaccaugcgcacgaugccuaucugaacgcugucuuggcaacgcuguuaaugaccucauuuccugagcucgagcccgaguucguuuacggaaaauaucgaaagacaaaauuuaagggccuggggaaagccacugcuaagaauaaccuuuacaccaauauucugcaguugcucaaggaagaaagugcccaauacugggacacaaaagagcgcgaccuggcaacuaucaagaaaaacguguaucaggcccaggugaauaagguacggaaagucgagagacagaccggaucuuucuacgaugaaacgguggcgaaaaagagcgcuucccaaaaacuauuuccaaggaagaacggucuggacccuguuaaauauggcggguaccagcgugccaaugagggauauucacuucucuuccgcgcagauaugcugaacaagcggggcaaaacaaagagcgugaagaccuuggucaaaauucccaucauagaaucugcucaguaccuggccgacccaacugaguauuuagcaaagagagguuacuacaauguguccgaacauagucuccugcuucccaaauuuagccuguuggagaacaacaaugggcucaggcgauaucuggccucuuccaacgaguuccagaaggcuaaugaacuaauccugccuaaacaccuuguucggcuccuguacuggucacaaaguaagcagcgcaaggaggaauugaacaaacacagagcggaguuugccgaauuauucacauauauuauggauuuugcagacaaguacgugguagcuccgaaaaauagcgagaagaucaaaaacauuuaugagaauaacaaggauucguccgucgaagugcugggcaaaaauuucaucgagcuccugaaguacaccgccgacggagccgcuucugauuucacuuucuucgacaccaagauaccaaggaaacgguauaacagcgcaggcgaucuucuggacgggacauugauuuaccagucaaagacgggacuauacgaaacccgaaucgaccugggcgccaucuga

SEQ ID NO: 2929 - RNA, 3957 nt, Artificial Sequence
  Cas9 variant
augaugaucaagcugaacaauaugaaaaagauucucggccuugaccuggggaccaacagcauaggaugggccguggucgagacagaagauaauaaaaaguucgaguuguuagacaaagguguuagaaucuuucaggaaggcgugaagauugagaaggggaucgaauccucuaaagcugcagagaggacuggauaccggucagcccgccgaauuaaguuccguagaaggcugcggaaaaucgagacgcuaaagguacucauagaaaacaauaugugcccccugaguauggaugagcuuaucguguggaaagaaaacaagaauaacuauccuaagaauaaaaucuuuuacaacuggcugaagaccaaagacccaaaggagggcacaaaugguacuuauauuaacccguacuauuuccgcaccgaggcgauuaaaagaaaguuggaaaauacaaacgaugucgggagggcucucuaccaccuggcccaacggcgcggauuuaaaagcaaucgacuggaguccaccgacgaaaagucuagaggcaucgugaagacugagauaaacaaacucucgucagaauuaaacggcagguaucugggggaguacuucuacgagcuuuauuugaagggagaaaagauucggaagcgucauaucagccgcgaggaacacuaccugaaugaguuuaaaaagauuugugaaguucagaacuucaauaaggagcuagcagagaaacucgaaagagccaucuuuuaucagaggccccugaagagucagaaaggucuugugggcaagugcacacugcaaaacaauaaacaucgguguccuaucucccgaccagaguucgaagaguuucgcauguggcaguucauuaacucuauaaaguacaagaauagcgaugggaaauuugacuucuugaacaaggaacagagagagaauaucauucccgcuuucgucuccaacaaaaaugcaaccuuugaguucucaaagaucgagaaaauacucaacaagggagugcacauuuaucaguuuaauuacaagaguaaccauacgaucggcagcaaucaaacuaugaucaacuucauggauguauuugacauugauaggaaacugaccaacgccugguuacugugcguuaauaagaucuaugaacucuacacagcuaaaacuaagaaagacgguucucuuaaguccaaaucagaagugauuaccgaugucuggcacgugcuguucacauuugacaacgaggagaauuugaaggaguucgcccggaacaagcuacugcucgacgaaagcagugcgcagaaauuuucuaagauaaaucugaaacaggauuacucccagcuuagccugaaggcaaucaacaaaauuuugccuuaucuccaagaagggcugaucuacucguaugccguguucaucgcuaauauugagaacgucauaggaaagucuaucuggaauauuaaggaaaaccagcagaucauucgcaccuccaucaaaaagauaaucgacaaucacaaaacggaguuagauauuaacacuaucacaaauucacugauuaacgacuuuaagguuaauuacaacaacgcccauaaagaguauaagguggaugacaucgaucuaaagaauauaagagagaaaauuaucaaguacuauggcaacaaaaccuggaauugucucccagaagacgaaaagcuguacguaaaagagaagguggaaaaacuuuacgagaaacaauugaagaguggcaaaagggggauuuucaucgagaagauacgucuggaugaccggaucgaaaacuuucucaaagauaauuucgacagcuccgagcugaaccuuaagaaacuguaucaccccucugacgucagcguguacaagucaguuaagauuacugauuugggacuccgacuguuagguaguccuaugaucccauccauuaaaaauccgauggcaaugagagcuaugcaucagcugaggaagcuaaucaaccaccucauaauugaaggcgugaucgacgauagcacaaucauuaaugucgagaugucucgcgaacugaacgacgccaauaugcggaaagcgaucgagagauaucagaggcagcgcgccaccgagaacgaagaguucaagacgaaaauuaaggaacuuuacaagaaagagugcgggaccgauuuugagcccaauaacgacgauauaaugaaguaucgauugugggaggaacaaaaucacaaaugucuguacacaggaaagucaaucggcauuugcgacuucaucgguaguaacccugcauuugaaauugagcauacuaucccacggagccucuccuaugauaacucucuggaaaauaaaaccuuaugugagaaggaguucaaccaacaggugaagaaaaaucguauacccuuugaacugucgaacuacaaggagaucauuagcagaaucaauaacugggaaauuaaagcugaggaacuuuucaagcagauccaaaaaguaaagauacaguccaggauggccgcuacaaaggagauuaaagacaaugccauccagcgcaagcacuugcuccagauggaguuuaacuacuggaaugggaaacugucacgguucacuagagaagauguuccugagggcuuuaagaacagucagcuaguggacaucggaauuauaaccaaauaugcaagggccuaccugaagacagucuucaauaacgugaauaccgucaagggcucuacuguggcugaauuucgaaacaucugggggcuccaggaguauuucgagaaaaaggaucgcagcaaucauauucaccauugcaucgacgcgauuacgaucgcaugucugacaaaagacaaguacgauuuucuugcccacuuguaucaccuggacgaacagaacaaucgggaugcuguucauagagccaugauaaaauccaagccaugggagaacuucgugcaggacguaaaagaaaucgagaaccaaauuuuagucucacacuacacccccgauaaucucccgaagcagagcaagaaaauccugaggaagcguggaaaaauucagaagaacgaaaauggugaccuuaucuaugagaaaggcgaugcagugcgcgggucucugcauaaggaguccuucuacggagccauaaagcgggaaauuaucaacaaaaagggcgagacugaagagaaaguuuuguacgugaagagaaaaccucucgaauuuagugaccuggguuucaagaccaucagcgagcuagagaauauugucgaugacgcugugagggauaagguacugaacgccgugaaagacaaggggcucaaacaagcacugaaugaacccaucuggaugaacgaggaaaagcagauaccaauuaaaaagguucgaugcuauacaccuucugucaccaaucccaucaaccuuaagaaacaccgggauaaguccaaacacgaguacaagcagucauaucaugugacuaaugacggcaacuacuugauggugauuuaugaaggaaaagacagucaggagaaggucaaacgcgauuacgagaucguuagcaaucugcaagcgggcgaauauuuuaagcagucggugcacgggguguuaaaggcucagggaauaaacaaucucgagggucugauuccaaaauucaaggaauccggcaaaaacauccuuccccugaaguacauccuaaaaacagggacgaugguaaucuuuugggagaacuacccugaagagauuugggacauugauaagaaucagcucuauaagagacuguucaaagucacccaauuugagucugacggaaggauacaggcccgguuccaucagaucgcaaagccagauaacgaauugacuaaagugagcgagcuggacuuuucaaauauugccgaaaagauccgauuaaguaaaggcaaccucaauaugcugguuaacgguuacgauuucaagaucaaugugcuugggcacauugagaagcuguccuga

SEQ ID NO: 2930 - RNA, 3957 nt, Artificial Sequence
  Cas9 variant
augggcagcaacaugcugaagaaagacuacuccaucgggcucgauauuggaaccaauucugugggucacgccgucguuacagacgauuauaaggugcccacuaaaaagaugaaaguauucggcgacacgucaaagaagaccauaaagaagaacaugcuuggggugcuguuguuuaaugagggacagacagcugcagauacuagauuaaaaaggggcacccggcgccgauacacacguagaaagaacaggcugcgguaucuacaagaaaucuucgccccugagcucgcgaaagucgacccaaauuuucuguaccgccuugaagagaguagccugguggcugaagauaagaaguaugacguuuacccgauuuucgguaaaagagaggaggaauugcucuaucaugauaccuacaagacuaucuaccaccugagguccgcccuggcaaacaaugaccagcccgccgaucuccgguuaguguaucuggcucuugcacauauuaucaaauaccgcgggaacuuuuugcuggagggagaaauagaccuacgaacaaccgauaucaauaaggucuucgccgaguuuucugagacgcucaacgaaaauucggacgagaaccugggcaaacuugacguggcugauauuuucaagaauaacacuuuuucaaaaaccaaaaagagcgaggaacuguugaaacucaguggcgccaagaaaaaucagcuggcgcaccaguuauucaagaugaugguagggaacaugggauccuuuaaaaagguucuggguacagacgaggaacauaagcucucuuucggcaaagauacuuaugaggacgaucuuaacgaccuguuggcagaagccggggaucaauaccuagacaucuuuguggcugccaagaaagucuaugaugcagcuauucuggccagcauccucgacgugaaggauacccagacaaaaaccguguucucccaggcgaugauagagagauacgaggaacaccagaaggaccugauugaacuuaagagggucuucaaaaaguaucugccugagaaaugccacgacuuuuucucagagccaaagaucaguggauacgccggcuacauugaugguaaaguuagcgaagaggacuuuuauaaguacacgaagaaaacuuugaaggggauccccgaaacagaggaaauccuccaaaagauugaugcaaauaacuaucugcggaagcagcguaccuucgacaauggagcuauaccucaucaggugcacuuaaaagagcugguagccaucguggagaaccagggcaaguacuauccauuucuacgcgaaaauaaagauaaguucgagaagauucucaacuuuagaauccccuacuaugucggcccucuggcuaggggaaauucuaaauucgccuggcuuacucgggcaggggaagguaagauaacaccauacaacuuugacgagaugauugauaaagagaccuccgccgaagacuucaucaagcauaugacgaucaaugauuuguaccugccgaccgagcccgugcucccuaaacacucacugcuuuaugaacgauacacaauuuuuaacgagcuggcuggcguucgcuaugugacugaaaauggggaggcgaaguacuucgacgcacaaaccaagagaagcaucuuugaguuguucaaacucgauaggaaggucagugaaaagauggugauuaagcaccugaaaguaguuaugccagccauacggauccaggcuuuaaagggacuggacaacggcaaguucaaugccucuuaugguacauacaaagaucuaguggacaugggggucgcacccgagcuccugaacgacgaagucaauuccgagaagugggaagauauuaucaaaacucuuaccaucuuugagggccgcaaguugauuaaaagaaggcuggagaacuaucgugacuuccucggagaagauauacugcggaaguuaagccgaaagaaauacacaggcugggggagacugucggccaaacuuuuggacggaaucuacgauaaaaagacccauaaaacuauucucgacugucugaugacggaggauuauucucagaacuuuaugcaacuaaucaaugacgauaacuacuccuucaaggaaacaauuaaaaaugcucaggugaucgagaaggaagagacccuggccaagacugugcaggagcucccugguucaccagcaauaaagaagggcauccugcagagucuugaaauuguugacgagaucauuaaagugaugggguauaagcccaaaagcaucguagucgaaauggcgagggagacccaaaagacacacggaacccgcaagcgggaggauagagugcagcagauaguugaaaacuugaaagacgcuaaugagcugccggaaaaguuaccuuccaacgccgagcucucugaugaaaggaaauaccuguauugccuucagaauggccgcgacauguacacuggugcaccccuggacuaugaucauuugcaauuuuacgacguggaucacauuaucccacagagcuuccucaaggacgauucaauugagaacaaaguccugacaaucaagaaggagaaugugcgaaaaacgaacgggcuaccuagugaagccguaauacagaagaugggcuccuuuuggaaaaagcugcucgacgcuggagccaugaccaauaaaaaguacgauaaccugcggcguaaucuucauggcggguugaacgagaagcugaaagaaagauucaucgagaggcaguuaguggaaacucgccaaauuacaaaguauguugcacagcuccuggaccagcggcuuaauuacgauggaaacggugucgagcuggacgagaaaaucgcuauugugacccuaaaggcccagcucgcgagccaauuuagaucugaguucaaacugaggaaggugcgagccuugaacaaucugcaccacgcucaugaugcauauuuaaacgccaucgucgcuaaucucauaauggccaaguaccccgaacuggaaccagaguuuguuuauggcaaauaccgcaaggcaaaauucaaggggcuuggaaaagcgacagccaagaacacucuguaugcuaauguguuguacuuucucaaagaaaacgagguguaccccuucugggacaaggcccgggaccugccuaccauuaagagauaucuauacagggcacagguaaauaaaguccguaaggcugagcgccagaucggcgguuucucagaugaaaugcuggugccaaaaagugacagcgggaaacuucucccgcggaaagagggccuggaucccguuaaguauggaggcuacgccaaggcaguggaauccuaugccgucuugaucacggcugacgaggugaaaaaggggaaaaccaagaaaguuaagacacuggugaacauuccuaucauugauucuaagaaauacgaggcggacccaacugccuauuuagcaucgagaggauacaccaauguaacaaacagcuuuauacuccccaaguacucccugcuugaagauccugagggcaggcgacgguaucuggcuucauucaaagaauuucaaaaggccaaugaguugauccucccacagcaccuggucgaacuacuguacugggugaacgccaaagacggugagcagaaacuugaggaucauaaggcugaguucaaagaacucuuugacaagauuauggaauuugcagauaaauauguggucgcccccaagaauagugagaaaauccgcagacuguacgaagagaaccaggacgcgacuccgauggaguuggggaagaauuucguugaauuacugagguauaccgcugauggagccgcaucugacuucaaauuuuucggcgagaacauuccucggaagcgauacaacagcgccgguucccuccugaauggcacgcuuaucuaucaaucaaagacagggcuguacgaaaccagaauagacuugggaaaacuauga

SEQ ID NO: 2931 - RNA, 3960 nt, Artificial Sequence
  Cas9 variant
auguucagccagagaaacaaucccuacugcgagcugcucuuuaagaucauugugaccaacauagaagagaaaaaucuugaagucaucaugggcauuaggaacuccgacaucuucuuuauuucuaauuucaugugguaucaaaagcugaucaugaugauaaagaacaucuugggguuagaucugggaacaaauucaauugguugggcccuaaucgagguugacgaaaacaauauuccuauccggauaauugcuaugggcagucgcaucauuccacucagcacuuccgauaaggaggaguuucagcgagggcugucuaucacgaaaaaccagaaucguaccgugucgagaacacagaggaagggauacgaccggaagcaacuucgcagaucagaucugaaaaagaucuugaaaaaguauaacauuuucccgagcgaagaacuccugaaacugcccaugcucgacuuauggaagcugaggagugauuccgcaaauccuaacgaagacauaucugccgagcagcuuggccggaucuuguacaugcugaaucagaagcgcgguuauaaaagcgcgcgauccgaggcuaacucagauaagaaagacacugauuacguacaggccgugaaggggagauaugcacaacuaaaagacaggcggcagaccauuggacaguacuuuuacgaggagcucaguacagccuucagcgauaagaacaaucagcaauauuuucgugucaaagaagagguguacccacgcgaggcuuauaucgaagaguucgacaccauaauuaacgcacagaaggacaagcacggcuuucugacugauaaaguuauccaucagcuuagaaaugaaaucauuuacuuccaaaggaagcugaaaucucagaagggcuugguguccaucugugagcucgaaggguuugagaaaacagucuaugacaaggaaaagaacaaaaauaaggugguauucguuggacccaaaguggccccuaagaccucaccacuguuccaguuaugccggauuugggaggucgugaacacgauaagccugaaaaucaagaaucccgaggguaguaaguacaaauggggcgaaaaggugccuaaccucaaacagaaggagauucuugcugauuaucuguuuaaaaaugaaaacuugucuuucuccacucuacuggagauccucgaacugaagaaggaggacgucuacguuaauaaacaaauccuuaaggggauuaaaggaaacgaggccuacgcggcacugcacaauguguugggcgaucaugaacuccugaacuuugacguaagcauaaucaccucggaucacacagccauuuuaguggacaagaaaacuggugagauccuggaggaacgagcugggcuagagcucgaugccucucuggaacgcgagccacuuuaucaguucuggcauaccauuuacuccuugaaggaccuggaugaauguaaaaaugcacucaucaagagauuuggacuggacgaggacauagcugaaaaacuuucacacaucgauuucaacaaacaggccuuuggcaguaagagcaacaaauccaugaggaagauucugccguucuugauggagggcuauaauuacucugagagcugcucacucgcgggguauaaccacaguaauucccugacaaaagacgaacgggagagccagaucaccuuagaacgccuggagcuacuccccaagaacaaucugagacaaccuauugucgaaaagauccuuaaccagaugauaaaugugguuaacacgauuuuggagaaauacggaaagccaucugagaucaggguggaacuggcccgugagcucaaacagucaaaggaugaacggaaugacacugaucugcagaacagucgaaauaaaaaguuaaacgaggaaauugguaagagacuggcagagcuuggcuugcccgucacaaaaagguauauccaaaaguacaaauuuauauucccuagccucuccaagaaucugaaagacgcucaugugaacaaucaguguaucuacugcggggagaccuuuaaccuaacugaagcccugaacggagaugcuuaugacguagaucacauuguuccaaaggcccuccuguucgacgauucucagacaaauaaggugcuuguccaucgcaaauguaacucgaccaagacgaaucagaccgcauacgacuauaucacagccaaaggcgaggaagaggugcggauuuacagcgagagagucgaugacugguuuaagaaagguaucauauccuauucaaagaugcaaagguugaaagugagucacaaggaauaccuggagcgcaagaaauuagggaaggaaacugagaccgacaaaaagcucugggaaaacuucauugaucgacagcugcgggacacacaguauaucucucguaaaagcagagagauccuucaaaagguuugcaauaacgugacuaccacagagggcggaguaaccgcuaagcugaggaauuuguggggcugggaugacauucucaugaaccugcagaugcccaaauacaaggaacuagggcagacuaucacgaaagaguggacauccgaacacggaaagcgcaaacaucagaaggaggaaauugagaauuggaccaagcgggaugaccacagacaucacgcgauagaugcacuggucguggccuguacuaaacaagguuucauccagaggauuaacacccucaauucaagcgagacaaaggaccugaugaucaaagaaguugaggaagcuaagauugaguuuaacgagaaaaccacucuuuuggaaaaguaccugaagacacagaaaccguucacgacccgagaggugaugaaggaagccgauaaaaucuuaauaucuuuuaaggcaggcaaaaaggucgccacuaucacaaaguucaaagcuaccgggaagaauaaagagacaggagugauuguaccucgcggcgcccuccaugaacaguccguguaugguaagaucaaaguuauugagaaggacaaaccccugaaguaccuuuuugagaacccagauaagaucgucaauagucggauaagagaccugguggaaacuaggcuaagcgagaacgaaaacaauucuaaaaaggcacucuccaccgugaaaaagaacccuauuuucuuuaaugaggagaaaaacgaaauccuggagaaggcgucaugcuauaaugaugcuacggucuugaaguacaaacugcaaaacuuaaaggccaaucagguugacgacaucguggaugaacgugugaaauuccucguaaaggagcgccugacccaguuugggaguaaagaaaaggaggcauucaaggacauucuuugguuuaaccaggaaaaacaaauacccaucauuacaguccggcuguucgccagaccagaugcuaauaacuugcagaucauuaagaaagacaagaauggcaaagauaucggauuugugcucacuggcaacaaucaccacauagccaucuaugaggacaaggauagcaagcugguucagcauucgugugcauucuggcacgcuguggagaggaaaaaguacaacauucccgccgucaucaaaaauuccgcggacguguggucucuacugcuugauaaggaacucccuguucuguucuuggacaaacugccagccgaugaguuaaaccucaaguuuagcaugcaacagaaugaaauguucauucuggggcuuucacaggagggauuugacgaagcuaucaaaaacaacgacaagagucuguuguccaagcaucucuaucugguguggucuauaagcaauaacgauuacuacuuccgacaccaccuagagaccaaaaauacagagcugaagaacauuccgacugcaaaagacuccaagcgguauuuucgcuucaaaucaguaggugcccuugucggcaucaaucccaucaaggugagacucaaccaucugggggaaauuaccaagaucggagaguga

SEQ ID NO: 2932 - RNA, 3960 nt, Artificial Sequence
  Cas9 variant
augggcuacaacaucgggcuggacauuggaaccgguagcgugggcugggccgcucucacagaugaggggaaacuugcaagagccaaaggaaagaaucugauaggcgucagguuguucgacuccgcgcagucugcugcccaacggcgcucauaucgaacuacgcguagaagguuaagucggcgcaaauggagacugaggcuacucgaaaacaucuuuagcgaugagauggguaugauugacgaaaauuucuuugcacggcugaaguacuccuauguucaccccaaagaugaggugaacaaugcccauuacuaugggggauaccuuuucccuacccagcaggaaacacacgacuuucaugagaaguuccagacuaucuaucaucugcgcuugaagcucaugauugaggauugcaaauuugaccugcgagaaaucuaccuggcuaugcaccacauaguaaaguacagaggccacuuccucaacucucaaucgaaaaugaccaucggcgauucauauaauccaagggacuuucagcaggcaauucagaacuacgccgaggcuaagggguuaaucuggagccugaaugaugcccaagaaaugacagacgugcuugucggacaggcggguuucggcuugaguaaaaaggcaaaggccgagcggcugcuauccgcuuuuucuuucgauaccaaagaggacaagaaagccauucaggcaauccucgcugggauagugggaaacacuacagacuuuaccaagauuuucaaucgugaacgcagcggcgaugagcugaaaaaguggaaacuuaagcuggacuccgaagccuucgaugagcagucacaagcgaucguugacgaauuggaugacgaugagauggagcucuuuaacgccauuagacaggcauucgacgguuuuacgcugauggauuuacugggggaccagaccaguaucagcgcugccauggugaagagguaucaacagcaucacgaugaccucaaaauggucaaggaaaucgcuaaaaagcagggacuuucucaucaggacuucuccaaaauuuacacugccuuucugaaggaugacacagauaagggcaugaaagcauugcuagacaaggccgaucuggcugacgaugugcucguagagauacaacagcggaucgaaucacacgacuuccugccgaaacagcgaacuaaggcgaauagcguuauucccuaucagcuucaccuggcagaguuggagaaaaucauagaaaaccaaggcaaguacuauccuuuucuccuggauaccuucacaaauaaggccggggagaccauuaacaaauuaguggaacuggucaaguuucgcgugccauacuacgugggacccauggucacggcugccgacguugagaaagccgguggcgaugcaacuaaccauugggugaagagaaaugaaggguaugagaaaaguccuguaacaccauggaacuucgaccagguguuuaauagggaucaggcugcccaggacuucaucgaccggcuaaccggaacugauacauaccucaucggcgaacccacccugcuuaagaacucuuugaaguaucaacuguuuacgguccucaaugagcugaacaaugugaaaauuaacggucacaagaucgacgagaaaaccaagcauguucuuauucaggaucuguucaaauccaagaaaacagugagcgaaaaggcaauaaaggacuacuauuugucgcaggggaugggcgagauccagauugucggacucgcggauaaaacuaaguucaauucuaaccuguccucauacaucgacuuaaguaaaaccuuugaugcugaauuuauggagaauccugccaaccaagagcugcuagaaaauaucauucagauacagacaguguuugaggacguaaagaucgcagaacgcgagcuccaaaaacuggcccuuccagaugaacagguucagcaguuggcuaagacucacuauaccggcugggggaaccugagcgacaagcuccuguccacaccgauuauccaagagggaucucagaaagugagcauuuuaaauaagcugcagaccacuucaaagaacuucaugaguaucauaacggauaacaaguuugguguccagcaauggauccaggagcagaauacagccgaaaccgcagacuccauucaggauagaaucgacgagcuuacuaccgcucccgccaacaaaaggggcauuaagcaagcguucaauguguuguuugacauccagaaggccaugggggaggaaccuaaccgugucuaccucgaguucgcuaaagaaacacagaauagcgugcggaccaacucucgauacaauagacugaaggaucuauauaaaucaaagacucugagugacgauguuaaagcacucaaggaggaacuggagagccaaaaguccucucuucagucggaaaggauaggagaccgcuuguaccuguauuucuuacagcagggcaaagauauguacacaggucaaccaauuaacaucgacaagcucagcacggauuaugacauugaucauaucauaccccaggccuacaccaaagacgauuccaucgacaaucgggugcugguaucaagaccugagaacgcuaggaagagugacucugccacuuauacaaccgaaguccagcagagcgcagggggccuuuggaaaucccugaagaaugcgggauucauuucacagaaaaaguacgaucgcuugacaaagggcggggacuacagcaaaggacaaaagacugguuuuaucgcccgacagcucguggagacccggcagauuaucaaaaacguugcuucucugauagaguccgaguucagucaaacgaaggccguggcaauucguagcgaaaucaccgcugauaugagaaggcuagucgccaucaaaaagcaccgcgaaauuaauucuuuucaccaugcauucgacgcccugcucaucacagcugcgggccaguauaugcaggcccgguacccagauagagacggggcaaacguguauaaugaguucgauuacuauacuaacaccuaccugaaggagcuuaggcaguccucaaguagcucgcaaguacgacgcuugaaacccuuuggauucgugguuggcacaauggcuaaggguaacgaaaauugguccgaggacgauacucaguaucugcggcacgucaugaacuuuaaaaauauuuuaaccacgagaaggaacgacaaggauaauggggcccucaacaaagaaacaauauacgccguggacccgaaggcuaagcugaucggcaccaauaaaaagcgucaggaugugucucuuuacggaggcuauauuuacccuuauagcgcauacaugacucugguccgcgccaacgggaaaaaucuacucguuaaggugacaaucucagcggcugagaaaauuaagaguggacaaaucgaacuguccgaguaugugcagcagcggcccgagguaaagaaauucgaaaagauauugaucaacaaacuggccauuggccaguuagucaauaacgacgguaaucucaucuaccugaccucuuaugaguuuuaccauaacgcaaagcaacuuuggcugccaacugaagaggccgacuugauuagccagcucaauaaagauuccucagacgaagaucugaucaagggguucgacauacuaaccagcccugcuauucugaagagauuucccuucuacgagcuugaucucaaaaagcuggugaacaucagggacaaauuuaucgcaguugagaacaaguucgauauuuugauggugauacugaaagccuuacagcucgacgcggcucagcaaaagccagucaaaaugaucgauaagaagagugccgacuggaaagauuaucgacagcggggaggcauuaagcugucugacacauccgaaaucauuuaccagagcacgaccgguaucuuugagaaacgcgugaagauaucgaaucuucuguga

SEQ ID NO: 2933 - RNA, 3963 nt, Artificial Sequence
  Cas9 variant
augaccgagcagcaaagacccuacaacaucggccuggacauugggacaagcuccauaggaugggccgugacugaucagaaugacaagcuccuucacaucaggggucauaacggcauugggguccggcuguucaaagaaggagagucugcugcagaacgccgaggcuuucguacgaccagaaggcgguugucacgcagaagguggcgguuacgcuuccuggaucgaaucuuugacgccgagcuagcgaagguugauccuaauuuccucgcuagacugaaacagaguaacauuagcccacuugacccgaauaagcagauguuugguaacauccuguucgaugacgcccaauuugaugaccagaaauuccaccagcaguaucccacaauauaccauuugagguccgcacucgcccaaccugaugcuccacaggcagacgugcggcugaucuaucuggcccuccaccauaugauuaaguuucgugggcacuucuuaaauggagcugccguagaaaaguuucacggcggccagcugcaucuugaggcggaguuccaggaauugaaccaaaucuuuucuaaucagcagcgcgaucacgugcaacugcagacuucgucacuagacgaggucgcaaccauucucaaagacaaccagagaacacccagcgauaggcagcgggaacugagugcccgacuuuucgugccuguugacaagaccaucgauaaagagaauaagaaacuggcuacugaguugcucaaggccgugcugggguuaaaggcaaaauucgacgucauacugggaguggaagcuacagauccacaagccuuuaagcuccaguucuccucugacgauuuugacgauaaaauugcggagcuugccagcgaacugaccgacgaggcaaacgaaaucuugacgguacuacagcgccuguacuucucccucaaucuggcugauauucuuacuaacagacagaccaagcaaguugccgacucaaucaguacagcuaugaucaauagguaugacgaucauaaacaccaccugaagauguugaaagagcucgagacucaggugacccaggaacagcgggacggucugaagaaggccuacgaugaguauauugacggcgauaaacccacaauagacaccuuuuacacgaacgucaagaaaaacuuagaugacagcgaacuggcaaaucaaaucaagucucuaauugaucuccaggccuucaugccuaaacagcgcuccaaggagaacgggucaaucccacaucagcugcaccaaagagaacuugaccaguugauagaggugcagggaaaguacuauccguggcugcucgcugcgaaagauaagcuggacgcacuuauugccuuuagggugcccuacuaugucggcccuaugaucgauccaaaugagagcgacgacccccaaaacacuaaauucgcuuggaugguucguaaggaagccggugagaucacaccuuggaauuuugaagagaaaguggauaagaccgggagugcaacuaacuucauuaagcggaugacaaccacggacaccuaccuguugggagaaccaguacuccccaaaaauucucuguuauaucagcaguuuacagugcugaacgagcuaaauaagcucaaagucgauggcaaggcccugacuguggaccagaaaaaguaccuuuaugagcauguuugcaagaaacaacgaagagugaccuugaagaaacuguccgauugucucauggcuaggggcgacuucccgaugggggccaucuuuacaggaacuaccgaucagaagaacaugaauaacacacugaaaaccuaccaggacuuccaggaaauuuucggugaugagauagacaauccugaucgccaagucgacuuugaaaagaugaucgaguggagcacuauuuucgaggaucgggaaaucuuuaaauuaaagcuggcagagcuuaacugguugacgucggaacagcucgagagagugucuaagaaaagguaccagggcugggggcgccugucccagaagcuacugacacacaucguaaaugaaaacggagagcgaauuauagaccaacucuggaacaccaaucagaacuucauggagaucaugggccaggacgguguuaaacaagcgauucaggaacauaauggggcuaacguggcccagacuggcaucaaugagaccauugaugaacuguauacaucaccccagaacaagaaagcaauccggcaaauacuuuuggucguggacgauaucaagaaggccgucggauacgcuccagccaauauuaugauggaguuugcacgugaagacagagaugaccacaggcugaucgcuagucgcgcccggcaguuagagaaaaccuaucaggagauuagcaagaacugguucgauaaugaauccgugacucaggagcucaaagaccaaaucaagaacaaaacaaaguuuacggauagacuguaccuuuauuucauacagggcgggauugaccuguacaccggacacccuuugaauaucgaucagcucucuagcuaugacauugaccauauccugccccagucauuucuacuggauaacagucucaauaacaggguucugacuucccaaagcgaaaaucgagugcacaaggaggaccgccuuccaggugaaacaguagcgaacaaaaugcggcccaccuggaagaugaugagagagcagggcuugaugacacagaggaaauacaacaaucugacuuuaaagccugaucagauaucuaaauucaacaaucgugggcaauuuaucaaccgccagcucgucgagaccagacaggugauuaagcuggccgcugacaucaugaaucaaaaguaccaggcagaucagacgaaaguugugaccgucaaggccaaccuuacacaucacaugcgggaaaaauucaauuuuuauaagucaaggaacgugaaugacuaccaccaugcuuucgaugccuaucugacuguauucgugggaaacuggcuacucaaagaguacccaaagcugcagccguauuuuguuuacggcgacuucgcaaaaaccgguacaaauaacuugaagaguuuuaauuuccuguaucgauuugaacgggaucacaaguuaaacgacaaaggggcgauugauacugacaaggaucaacagcucggcuacaugaaacgcaucuacagauucaagaaaaugcuggucaccaagcagcuugagacgaaugagggagcccuguauaagcagacaauauacaaagcucccgccaacgaaaagaacaccaaaaagaauaggagcuugauuaacacuaaaaagaaucggccuuccgacaucuauggcggguacucucaaucggugacagcauauaugagccucguguuuuucaagaacaccuuuaaacugaucaagaugccccuagucgcugccaaugcaauuaaaaacucccugucaaguuaccaugacacuauccuuaagauucucggaucuaaugaguucaaaguucugauaccaaaggugaagaugaaccaguugaucaaagaaggugauagccuguauaccgugguaggcgucuacaagcacaaugcccagcaguuaauucucuccgacaacucaauggggaucauuacaaaaccuauccgagagauaugcgauagcgaccuggauucuguguuuaaugaacuuguugacaacaucgauaaguaccugaauuuguauaaaauugaggacaagcucacgaucaaggagaaauucuacgcucugaagaacaaagaauccaaguucaaauguauuagugauauccuagugggaacccauugcaaugcgggcagaagcaaccugaagauaauuggucuuucuuccuauugggggauguuuucaggcaauaacgacggacucaaaaucaacgagaauagucaacugaucuaccagagcccaacuggcuuguucgaacaccgcgucaaggugucggauuuauga

SEQ ID NO: 2934 - RNA, 3972 nt, Artificial Sequence
  Cas9 variant
augaaggacuucuacaucggccuggauauggggaccgacagcgugggaugggccgucgcugaugaggacuauaaccucugcaaauuuaaggguaaagcaauguggggcguuagacuuuucgaugaauccgccacagcggcugagaggcggggguuucgcacugcccgacguagagcacagaggaagcggcaacgcauucugugguugcagauguuauucaaugaagagauaucuaaaaaggacaucgccuuuuuccagagacugaacgaaucaaagcuauaccucgaggauaaaaguacgaaugugcccuaugcuguauuugcagacgagagcuucaccgauguggacuaccacaagcuguauccuacaauuuaccaucuuaggaaagaacugguccaguccgaugagccacacgacgugcgguugguuuaucucgcccugcaucaccugaucaagaaccgcggacauuuucucuucgaaaaugugggcucugauuuugagaaagagucgucauucgaagucuuauuuaagaaccugcaaaauuacauucuuggugaguacgaauuggcucuggaguguaucagcccgcuacagauagccgacauccucaaggacaaaaguaagcgaaaaacuaccaaguccucugaaauuugcaaacugcuugggaucagcaagaaaggacagcccagacugaacgcgauuguguugcucauguguggccaguccguaaagcuggcagauuuauauggcgacgagaauuacaacaaggaggaaaaaucaaguaucagcuucgagaagggguaugaagauaaugaggaaacauacagggagcugcuccuugagcgguucgaacugauagagaaaauuaaggccuuguaugacugggcuauccuagccgauauucugaaaggagaaaccuacaucucuuuugcaaagguuaagacuuaugacgagcaccgucacgaucuccaacagcugaaggcuuucgugaaagaacgcugcagauccgacuacaacgagaucuuuagggagacaucagauaaacuuaauaacuacaccgccuauugugguaaguucaaagaaaauggccggaacggggucauucugcauagcgcgaaccagacggacuuuugcaaguacuugaagaguaaauucgauaagcucgacaaaucuggauaugaggacauguuugaaaagauagagaauggcuccuucaugccuaaaaucguggugaaggauaacggugucauuccaaugcagguuaaugagagcgaagugcgagccauccugaagaacgcaucgggguacuuagacuuucugaauaaccaagauaaagacggaauaacuguagcugauaagauucuacagaucuucgaguuucgcauccccuauuacgugggcccucucaauguccacucugacaacuccuggcuggugagaaaagauggcaagauuuauccauggaauuucaacaaaaucguugacguggauaagucagccgaagaguuuauuaauaaacuuaccgcuaaguguacauacuugcccgacagggaugucauaccuaagaacaguauccuguacagccgguauauggugcucaaugaacugaacaaucuuaaacuggacgggaagaaaccagauguauccuucaagcaggccguuuucaacgacuuguuuaugcaucgcagaaaagugacucaaaaggcacucagggaguacauuaaggcccagaccggaacagagccggaaaucaccgguaucgacggcgauuucaaagcuaacaugcgucccgcgauugagcuggcaggguauaauuuaucugaaccugacaaggaggaaauaaucaaagccauuacgaucuuuggagaugacaagaaacugcuaaagcggcgaauuaaggauaaauacagcgagaugcucucagaggacgaaaucaagaaaauaugcaagcugaaauauaaggauuggggcagacuuaguagggaguucuugacugaaaucuuugacgucgauacagcuaccggugaguguaaggacaacauuaucaauacucuguggaacacaaaugauaaccucauggaacuguuaggggccaaauacaauuucacccaguccauugagcaggcaaucagcaagucuacgcacaaagccucaauagagaagaugguggaagacauguaugucaguccaaaagugaagcgcaccguuuuucaaagccugaaaauuaugaaggagaucgugaagauuaaaggccacgcucccaagaaaguauucgucgaaaugacacggcaugauggaacuaagggcgacaacgggagaaccaaauccaggaagaagcagcuugaggaguuguacaaaaagugcaaagaagacucuacagagcucugggaugaacuggagaagacugacgaugacgaauuucgccaggauaaacuauuccuguacuauacccagaugggacgauguauguacucgggugagcggaucgagcuccgugaccuguuuaauaagaaccuuuaugauauagaccacaucuucccuagaagcaaggugaaagaugacuccauugauaauaggguuuuggugaagaaacaaaucaacucacauaaggacaaugacuacccacuggauaguacaguccgcgagaaaaugcggggccacuggcaguauuuacucagacauggguuuauuucuaagaagaaauacgacaggcugacccgagugacuccccuuacggaugacgaacuggccgauuucaucgcacgccaguugguagaaacaagccaguccaccaaggcgguggcuacucuccugaaaacccuauauccgacaaccgagauaguuuacgucaaggccgaacuggugucacgguucagaacugaguacaaauuuauuaagugcagggaggugaacgaccuccaccacgcaaaggaugccuaucugaauaucgucguuggaaacguguacaacgugcguuauacacauagcaaagcuaucuucauuaagggccuucaaacgaaaaaguacucuuugaaucgcauguuugccuucgacaccccuggugcauggaacaucgaaaaugagaaaucccugaguauuguaaagaaaacugucaugaagaacaauauauuauauacacgguacagcuauaugaagaaagggggccucuuuaagauccagccccugaaaaagggaaacggccaggcuccacuuaaaaaggaucugccucuaucugacauugggaaguacggagguuacgauaaacccaccgccuccuauuucucauacaucaaguaugaaggcaaaaaggggaaagagugcagacagcucguggcgauugacaauuaccugaagaaguauuacgaagagaacccaaucgaguauuugacaaauaggcugggacucaaaaaccccgccguuuuaauaccugugaucaaguacaauaguuguauugaaaucgauggcuuucgaaugaacauuagcucgaaauccaaugaggguaagacuaucgucuacaaaccagcugugcaacugguucuuggggcagaaaaggaggccuaugugaagaaaauaucuaagguacugagcaaaccggaggaacagaagauuaccucauacgacggcgucagugcugaggaaaacaucgaguuguucgacgcccucacggcaaaaaugaccaauacaaucuuuaagauuaaacuggaagauauaggaaacaagaucaaguccggccgggacaaauucgugacucuagaugugaagaaacagugcuaugucauuaacgagauccugaagauuaugcacuguaauguugugaccggggaccuuucucucaucggagcggccaaaaaggcuggcauaguaagcacaaacuccgcccugucagagaucaagaaagugagcaguauuauguugaucaaucaaucugucacuggucuguuugaaaccaagauugauuuacucaacaucuga

SEQ ID NO: 2935 - RNA, 3975 nt, Artificial Sequence
  Cas9 variant
augagagccaagggcaaaacccugaucgggacaagccucuucagggagggaaacacugcugcagaacggcgcgguuaccgaacgacccagcguagacuuaagaggcggaaacgcagacugaaguuguuagaggccuuuuucgaccccuauauuuuugaaguggaugagaauuuccuggcgaggcuacacgaagcugacauauccccuaaagaugagaacaagcgguuuuggggcucucuccuguucccaaaugagaaggacgccaacuuuuaccgcaaauauccgacaaucuaccaucuucgaaaggcacugauggaagaggauagaaaauucgacgucagggccauuuucuuggcuauccaccauauuaugaaguaucgggggaauuuccucucaccccugaguguugauagcuuuaaacaagaaggacuggagcucaaggagcaguuagaccgucagcugaagcgcguggcagaacuuuacaacgaguugaauacugauguaaaaaucaacguguccgacgucgaaaccauacaggauaucauuaucgacaagaauaaaucuagaagggauaaggccggcgcucugaaaaagcuacucgccgugucgucagaccggaaagagauuaacaagcugaaugcgagccuugcaaaggaacugaguaacgccaucuuggguaugaaagcucaauucgccaaucuccuguuagcagacgaucuggagauagacaagaacaaaaagaauuuuucccuccuugauacaaacgcugaggaaaacguuucugggcuguuggagcuagugaaugaaaaacaggccgagcuguucgacgcgauuaagaccauccacgaucagauuauccucaacgaaaucgucccugacggaaagagcauuucccagucaaugguggauaaauaugaggcccaucgagagcaacugcagguacuuaaggcacuguacgagaaaauggacgcuaagcagauaaaagccaucaagaaggcuuacaguuuguauauugauggcaaagacccaaaggccaaaaagguugauaaacgcgcacaccagaauagagccgacuucuacaaggaagugaagaaaguccucguggaacuggacgauagcagggcugagaaguuacugggccuaaucgaaauggggcaauuucuccccaaacagcggacugcgaugaacggagugauaccuaaucagcugcaccaagucgagcuugacaagauuaucgagaugcagucuaaauauuacccaugguuggcagaaaagaaccccguuaaaucccaucagaagcgcgccccuuauaagcuggaugagcuccugacauucagagugccauacuauguagguccgauggugaccaguaaaaagcagcaacagacgagcaauaguaacuuugcuuggauggucaggaaacaggaaggcgagaucacucccuggaauuucgaggaaaagguggacaccauugccucugcaaacgauuuuaucaaacguaugacagccaaggacacuuaccuuguuggggaggaugugcugccugcuaauuccuugcucuaccagcgguauaagguccugaacgaauuaaauaacauuaaagugaauggacgaagacugccaguagagcuaaagagggaagccuacguugcacucuucgagaacggcgacagcaaaaccgugucggcgaagugcuuuaaaaacuggcugaaugucaaguugaagaaccuuaauucucugaaacucgagggucuguccacagggaccaaguucgauaacaauuuaucaacguaucacgaccugaaaaagauauuuggaaaagcuguggaugacgccggccgccaaaaggauuucgaacagaucauugaguggcuuacuaucuuugaagacaagaaaaucuugcggauuaagcucaaagagauagaauggcugacagaggagaacaucacccagcuaacuagacugaauuacaacggcugggggaggcucagucgccgacugcuuacaggaauuugugacagcaauggucagcggaucauggauugguugugggacaccacgaacaauuucaugcaaauucagucccagcccgauuuucagaaggcaaucgucgaauauaacucugacaaacuggagcaaggcgauauagaacagaucuuaggggaggccuacaccagcccucagaauaagaaagcuauucguaaggugaucaagguugugcaagacguagaaaaagccaugggagcaaagccaacaucaauuaguaucgaguucacuagauccgauggcaggagcgagcucaccaacucucgcaugacacagcugcagaaaacucuuaugucacugagugaagagaugaccgaccaggcuuugcucgccgaauuuaaggauuuucaagcgagcaaaaagaagcugacaaauaaauauuaccuauacuucacccagcugggucgggacauguauacuggggagccccucaacauagaucagcugucccuuuacucugacggcgaucauauuuugccgagaucguuuaucaaggacgacagccuggauaacagggucuuaacgaaacgagccgugaauaacgagaaguccgacacaguuccugugugcgaauauggagcuaaaaugaaggauuucuggaaugaccucuacgauaacggccugauuucaaagcagaaacuugcaaaucugcuaaccgaccccgaugagaucgggccauauaaggccaacggauuuauacgccggcaacucgucgaaacuucacaggugaucaaacugucugcugagauuuugcagacccuguaccaggacacaaagaucauugaaguaagacaaaaauauacccacgaguuaagggagcacuucaauuuugugaagauccgucagcucaacgauuaccaucacgccuucgacgcauaccugacugcguuuagcggucgcuaucuuuaccagcgguauccuaagcugagaggcuacuucguuuauggggauuacaauaaauuugacgccaagaaagacaggaacuauuugaaguccuacaauuuccucuacgaucuggaagagggaaaaacagaccaaauagucgauaacguggaacauaagguguuuaugaaucgacaggacgcuauuaaccagcuaaagaaagccuaugaguacaaguauaugcuggucucacaggaaacguacaccaauagcggcgcaauguucaaagagacuaucuaucccguuaacccaaagcaaaaacuuauccagaagaaaaacgauaagcccguggacauuuacgguggguauucuaauaacuacgaugcuuaccucuccaucgugcggcuggaggacaagaaaggcauuaaguuccgcguagucggaauaccuaugagaaauaaagccgaauuggauaaccuggcaaaggaggaccacaauggcuauaugcagagguuaaacgaaaucguggaugagcagauuaauaguagcgggaaaaagaagacauuucggaucauucucccaaaaguucauuucaagcaacugguggaagacgauucuggaaaauuuaugcuugguuccgccgcuuacccguauaacgcgaagcagcuggucuugucagugaaaaguaucgagagccucgccaauaaggacgcaucggaccgagagcugguugcuguguacgaagagauacuaaacguagucaaugauaaguucacccuguaugacgccagacaguuucgcaacaaacuuacauccucuaaggauaaauucguggaacucaauacugccgacaaggugaccgagcuguuggauaucuuagacggccugcacgcuaaccccgucguuaaaaagcucaagauuaucagcgggucaccuuuuggauuccugcagaggccaaguggcauugugcuuacggagaaugcaaaacugaucuaccaaucccccaccgguauauuugaacguguaguguauuugcgggaucuauga

SEQ ID NO: 2936 - RNA, 3984 nt, Artificial Sequence
  Cas9 variant
auggagggccagaugaagaacaaugggaacaaucugcaacagggaaacuacuaucucggucuugacgugggcaccagcuccgucgggugggccguuacagauacugacuacaaugugcugaaauucagaggaaagucuauguggggcgcuagguuguuugaugaagcaucaacggccgaggaacggcgcacccaccgagguaaccguagaagguuagcgcggcgcaaauauagacugcuacuccuggagcagcuuuucgaaaaggagaucaggaaaauugacgauaauuucuucguacggcugcaugagaguaacuugugggcugacgauaagagcaagcccuccaaauuucuccuguucaaugacacaaacuuuacugauaaggacuaccugaaaaaguauccuaccauauaccaccuccgcucugauuuaauccauaauucgacagaacacgacauucgacugguguuccuugccuugcaucaccugaucaaauauagagggcacuuuauuuacgauaacucagcaaauggagacgucaagacccuagacgaggccgugagcgauuucgaagaguaccucaacgagaaugacaucgaauuuaacauagagaacaagaaagaauuuaucaauguucugagugauaagcaucuuacuaaaaaggagaaaaagauuucccugaaaaaguuguauggcgacaucacagauucugaaaacauuaauaucagcgugcucauagagaugcuguccggcucaaguauuagcuuaucuaaccuguuuaaggacaucgaguucgaugggaaacagaaucucucccuugacucagauauugaagagacccugaacgacgucguggauaucuugggagacaauaucgaccuacugauucacgcuaaggaaguauacgauauagcaguucucacgagcagucuggguaaacauaaguaucuuugcgacgccaaaguggagcuguucgaaaagaacaagaaagauuugaugauccucaagaaauacauuaagaaaaaucacccagaggacuauaagaagaucuuuucuuccccgacugagaaaaagaacuacgcugccuauagccaaaccaauucgaaaaacgucuguucucaggaagaguucugccuguuuauaaagcccuacauuagggauauggugaaauccgaaaaugaggacgaagugcggaucgcgaaggaggucgaggauaagucauucuuaacaaaacugaagggcacuaacaauaguguugugccuuaccagauccacgaacgugagcuaaaccagauucucaaaaacaucguagcauaucugccauuuaugaaugacgaacaagaggauauuagcguggucgacaagauaaaacuuaucuucaaguuuaaaauucccuacuauguggggccuuugaacaccaaguccacacgcucuuggguuuacagaagcgaugagaagaucuauccauggaauuucucaaacgugaucgaccuggauaaaaccgcccaugaauuuaugaauaggcucauuggacgguguacguacacuaacgaccccguccugccuauggacagucuucuguauuccaaguacaauguguugaacgagauaaauccaaucaaaguaaacggcaaggcuauuccgguugaagugaaacaggccaucuacacagaucucuucgagaauagcaagaagaaagucacccgaaagucuauuuauaucuaccugcugaaaaacgguuauauagaaaaggaggacaucgugucagggauugauaucgagauuaaaaguaaguuaaagagccaccaugacuuuacucagaucguccaggaaaauaaaugcacacccgaggaaauagagcgcauuaucaagggcauucuaguguacuccgaugacaaaucuaugcucagaagguggcugaagaacaauaucaaaggacuuucggaaaacgauguuaaguauuuggcaaagcugaacuacaaagaguggggccggcucagcaagacccuguuaacggacauauauaccaucaauccugaggauggggaggcuuguuccauucuggacaucauguggaacacaaaugccacucuuauggaaauuuugucaaacgaaaaauaccaauucaagcagaauaucgagaacuacaaagcggaaaauuaugaugagaagcagaaccuccacgaggaacuggacgauauguacauaaguccagccgcacgcagaucuauuuggcaagcucuaaggaucguggacgagaucguagacauuaaaaagagcgcccccaagaaaaucuuuauugaaauggcucgugagaagaaauccgccaugaagaaaaagcggaccgagucacgaaaggauacacugcucgaacuguauaaaagcugcaagucucaggcagacggauucuacgaugaggaacuuuucgagaaauuguccaaugaaaguaacagcagacugaggcgcgaccaguuauaucucuacuauacucagaugggucggucuauguacaccggcaagagaauagauuuugacaaacugaucaaugauaagaacacauacgacauugaucauaucuauccuagguccaagauuaaagacgauucaaucaccaaucgcguccuuguggagaaggacauaaacggggagaaaacugacaucuacccaauuagugaagauauccgacaaaagaugcagcccuucuggaaaauucugaaggagaagggauugaucaaugaagagaaauauaagcggcucacgcguaacuacgaacugacagacgaggagcuaagcucguuuguugccagacagcugguggaaacccagcaauccacuaaagcucucgcgacccugcuuaagaaagaguauccgucugcaaagauagucuacagcaaggccggcaacgugucagaguucaggaaucgcaaagauaaggaauugccuaaauuucgggaaauuaacgaccugcaccacgcuaaggaugccuauuuaaauaucguaguggguaacguuuacgacacaaaauucaccgagaaguuuuucaauaacaucagaaaugagaacuacagucucaaaagggucuuugauuucuccgugcccggggcaugggacgccaagggcucuacuuuuaauacaauuaagaaauauauggcuaagaacaauccaauaaucgccuucgcaccuuacgaagugaaaggagagcuguuugaucagcagauuguccccaagggcaaagggcaguucccaaucaagcaaggaaaggacauugaaaaauaugguggcuacaacaaacuuagcuccgcguuccuguuugcuguugaguauaaggggaagaaagcccgagagcgcucacuagaaacgguguacaucaaggauguggagcucuaucugcaggaccccauaaaguacugugaaagcguauugggacugaaagagccucagaucauuaagccaaaaaucuuaaugggcagucucuucucuauuaauaacaagaaacuggucgugaccggucgguccgggaagcaguacguuugccaucacaucuaucaacuuagcauaaaugaugaagacucgcaguaccugaagaacauugcaaaauauuugcaggaggagccggacggcaauaucgaaagacaaaacauccucaacauuacuucagugaauaacaucaagcuguuugauguccuauguacaaaauucaauucuaacaccuacgagauaauucugaauagucuuaagaacgacgugaaugaaggaagggagaaauuuuccgaacucgauauccuggagcagugcaacauuuugcugcaguuacucaaggccuucaaauguaaucgugagagcucuaaccuggaaaaacuuaauaacaagaagcaggcuggcguuaucgugauaccccaucuguuuacaaagugcagcguauucaaagucauucaccaauccaucacuggguuguuugagaaggaaauggaccuccugaaauga

SEQ ID NO: 2937 - RNA, 3984 nt, Artificial Sequence
  Cas9 variant
augaagaacuacagcaucggccuggacauugggaccggauccguggguugggucugcauagaugagaauuaucagauccucagauacaacaauagggccgcuuucggcguucacgaauuugagacagcacauguggccgaggagcggcgcauuaaacgaggggcgcguagaagguauaaccggcgcaagaaaagaauccaacuucugcagucuuuguucguaccccacaugcagcagaaggcguuuuucgccccuacuauuacggaacauuacuggaaaaaugacaaccaauuugagaauaggaccuuaucagaggugcugaugagucuaggaaugaacccaaauacauauccgacuaucuuccaccuccggcaugaacugauagagagcuccgucaagaaggaugcacgccuuaucuaccuggccuugcacaaccucgugaaauuucgaggccacuuccugcaggaagguucuaccuggaaugcuaacaugucggacgcaaaucugucagagcaguuugagcagcucuuacauauuuauacagaaauggaggaacugccccaaguuagccuuaccgcccagcagaguacugauguggagcacaucuugcugaacaaucauauuuccaaggcugaaagagccaggcagcuaacagcucucuucgagcggaccuacgagccauuuuucaaacugaucgucgggcuugacauagcagccgcucaacuguuuaagcagucugaacagcaauugcucuacaaagagagcaagacgaaggugaaccugacugccgaaaccuuaccugagguacugcagacaaugcucgaacccgagguugcauucauugaggcugugcagccuuucuaucagcaaacuguccuuuuugaucuguugaaaggacaguccuacguggccgcggccaagguggaagcauucaaccaguaugagcgugaccuagcucugcucaaaucagucaucaaugaaguuggcagugagaagcaguaccgcgccuuuuucauuaccagcaaacaaaagaaaagacaguuugaacagaagccaaacauggagcugcuuugucaccuggauagguucaaucgggagaagaaauaugaagagacauuuuacaaggaagugucuaaauugcucaccgcucugaucaaggaggccacgggcgagguaaaagaacacaucgagcagauuauacaagcaauggaaucccagucauucuuagugaagcagaaggggauccagaacgccagcauucccuaucaaaauagucuguacgaggcugaaaugauccuacgaaaccagcaggcguacuauccuuggauaacugacgaguuuauugagaaagucaagcaacucaucgcauuccgcaucccauacuauauuggaccgcuggugcagggugaugaacagcccuuuggcuggcuucagagacaagccgacgggaauaucacaccuuggaacuucgaugagaaaguuaauaaggcugccucugcagaauccuuuauuaccaggaugacuaaaaacugcacauacuugaaggaggaaaaggugcugccaaaacagagccucauguaugagaaguucacccugcuuaaugagcugaacucgguccagauacggucuuccuuggaacagccccauaaaaagcaccgccucugugaggacaugaaacaauggaucauugaacauguguucaagaagacgaaaaccguaacacacaagacucugauccaggcccugaaaaagucaccuuacaaagacgaguuauaugaugaaaguaccggaaauuggaaggacguuuacggcacacagaaagaggauagauuugcuagcucccuaucuacuuacaucagccucaaggagauugugggugacauagucgauaacgccuucauggaagagaucauuuauuggcugaccguguuuacagacagggauaucauuacccuuaagaugaaugacaaauacccauucaucacugaacagcaaauacagcguuugcugucacucaacaucaguggguggggacagcugucccaacgguuacugcagagcauucccgucgaugacaugaaccgaucugugaucgaguauauggagaagcaugcaguuaauuuuauggaacuuuugucaccgagacagagugaucucgcguacaaaauugaacaggugaacaagcaacacagcaaaaagauccacaagauaagguaugaagacauugagcagcugacgggcuccccugcucuaaaacgcggcaucuggcggucuguaaagauuaucgaggaacugacagccauauucggggagcccaaaaauaucaugauugaagucgcaagagaggaccaggccucgcauaggaccaagagccgcaaagaacagugggaguccaucggaaagucacucgcuaaggaagagaaagagcugaaggccuuuuucaaagaaauggcacaauacccaaagcagcaguuugaucgaacucgguucuggcuuuaugugacccagcaagguaaaugcuuguacacaggcaagacccugcguuuagaggaccucaguucuuacgaaauugaucacauccugccuagaaacuuuguuaaggacgauagcauagacaaucuugcucugguguaucccauggccaaccaggagaaaaauaaggcggggaacaauaaaaugccauuggaaauuaucgaugccaagcagcagcccgcuaugauggcacauuggaaaaggcucaaccaacugaagcuaaucuccgacucaaaacugcacaagcucaugaagccuagcuucaaugaugucgacaaagagaacuuuauugcccgccagcugguggagacucggcagaucauuaagcacguaagagaucuuuugcaagaaagguucgagcauacagacauacacgugguuaaagcuaagauggucucucaguuccgaaaauuuucccgcaucccaaagauucgggauuacaauaacaagcaucacgccauggacgcacuguucacgaccguguuaauccaguuuauucuccagaaauauggaaagaauuuccugcaauuugaccuucagcauaaagauaucaguaagaaauggagcaagauagcgcagucuacuaagcacuucuuucuguuccagcaauuugccgaacagcagaucaaauccccggugacaaaggagcuagucucaggcguucaguacuucgagcacaucuuuuaugaacaaaguuggcagaccacaaaaaugacucagaccauugacagcaacuucuacaaggagacgauuuucucgcccaaacucaagaccgcuaaguauacauccgccaaagcagaaaaguuugugcaugaugcuaucgugaaauacgccguaugugguauacaauacacuucucugaagaaaaacaaggagcagcaccaugucuugcugaccgacauuaaugugaucgaacacuaucaguuaaaggaggcaagccucaacgagcuggcccuucaucuggcuaaaagagaaucaaaggaugacguuaucgaugcgcagauguugguggucauuccuaaauacaagaaaauaaugcucaaugggaguccauauuacugcaucuccucugacgagaggcacauugccacacaauucgugcugcguaaggaucuacuggaagcaguucuucacgugaacgacgagacuagcguagaugaacuccgcacccuguuucgguccaucgucgaggagaugaugacgcaguauaaaguguacaauaaggacacaauuagaaacaagaucgaugcuuucauagaaaccgaguugaucgacguggaaacuuuucaggucggcuucacagagauuaaaaagaugguugccgccaaugcucagaggucagacaaauuuggaggccgacugcggcaagugaugaagguagaagauaucuauauuaucgacgagagcauaaccggguuacgcuacagaaaacccaggaagcucgugaaguga

SEQ ID NO: 2938 - RNA, 3984 nt, Artificial Sequence
  Cas9 variant
augaagaaaaacuacaccaucggccuggacauugggacagccagcgugggaugggcuguccucacugaggauuaugaacuuauaaagagaaaaaugaagaucuccgguaauacgcagaaaaaggcaguuaagaaaaacuucuggggcgugaggcuguuugagcaaggggaaaccgccgagggacggcgcuugaagcgaacaacucguagaaggauugcgcggcgcagacagaggauccaguacuuacggaccauuuucgacgaaggcaugaaucagguagaugcuaacuuuuucgcccgccuggacgagucuuuuucaaucauagaugagaaagaaaaugagcgacaccccaucuucgguaacguggcagaagaggccgcuuaucaugagcaauuuccuacaauuuaccaccuaagagaacaucucgcaaauaguagcgagcaggccgaccugaggcuugucuaucuggcuuuggcccacaucauuaaguuccgggggcauuuucucaucgaaggagagcugaacaccgaaaauuccucugugucgggcacuuucgagcaguuuauaaaaguuuacaacgagacauucaauguggaaaaggcgcuggaucucaccgucgacuuagauggcauugcagagcagaagaucucacguaugaaacgcgccgaacugauucuuagcuuguuuccagaggaaaagaguacgggggacuucgcucaauucaucaaaaugaucgugggaaaccaggguaauguaaagaaaacuuuuucccugaacgaggaugccaagauucaguucucuaaagaggaauaugaggaaaaucuagagacccuccuggcagaaauaggcgaggacuuuagaagcguuuucgaugcugccaaguccguguacgacgcgaucucacuugccaacauucugaaggucacagacgcaacuaccagggcuaaauugaguagcucuaugguggugcgguuuacagaucacaaggaggaccucaaaacccugaagcgauucguccgcgaaaacuuaccggaugaguacgacgaucuguuuaaaaauaagaagguugccggguaugcuggauacaucgacggcaacgaaacgcaggaggccuucuauaaauaccucaagaaaacucuugcaaaggccacaggugcugagggguuucuggcgaaaauggaacaagaggauuucuugagaaagcagaggaccuuugacaauggagugauacccuaucagcuacaccuggaagaacucaaggcaauuaucaaaaaccaaaaguccuacuauucauuccuggaugaagagaaaaucagccagcuuaugacuuuucggauuccuuacuacguaggcccacuggccaaggagaaaggccaguucgcuugguugacacgcaaggaaauggggaagaucacccccuggaaucucaacgagaaaguggacauugaaaagagugccacggauuucgucgagagaaugaccaauaacgacucuuaucugccuauggaaaaaguguuaccaaagcauucccugcuauacgagacauuuacuguuuauaaugagcucaccaaagugagguacauagacgauaacggacgugcacagaauuucagcucgaaggaaaaacggcaaaucauuaacgagcuguuuaagcagcagcgaaaggucaaaaaggaaaugcuugaggccuucuugaaaaaugaauaugguaucgagaaccccaagguggagggcaucgaaaaaucuuuuaaugcuugccuggggacauaccacgaccucauuaagcugggaauaagaccugagcuuuucgaacagccagagcaugagcaacaguuugaacagaucguaaagauucugacuguuuucgaggauaggaaaaugcgccggaagcaguuggaaaaauuuuccaacauccucaccgaggaggagcaaaagcagcuggagagaaaacacuauaagggcugggguagguuaucagccaagcugauucacgggaucguggaccagaaaacacagaagaccauacuagauuaccucaucgacgaugacgaucugccgaaaaaccgcaaucgaaacuucaugcaacuuauuaaugacgaaaacuugaguuuuaaggaggaaaucgagaaaauugcauucgauaaugacaagagcacugaagagaucguccaggagcuggcgggcucccccgcuauaaagaaaggcauucuccagucucugaagaucguggaagagauuaucgauauaaugggagaauuaccuacgaacaucgucguggagauggcccgggaaaaucaaacaaccgcacaggggaaccgugccagcaaagcuagaaugaaguaccuggaggagucaauuaaaaagcugggaaguuccaucuuggaagacgagccaauuagcaaagacgccaaucuccugaggaacgaucgccuauuucuguauuaccuccagaauggucgggacauguauacuggcaacgaacuggauaucaauaaccuuucuucauacgacauagaucauauuguuccccagaguuucgugaaggacgauagcaucgacaauagaguauugaccacauccucuaugaacagggggaagucgaacaccgucccugcagagagcgugguuaaaaagaugcgaccaacuugggagcgccuguuagcuuccggacucaucucaaagaagaaauucaguuaucugacaaaggccacgaauggcggucuuaccgaagaggauaaggcgcacuuuauucaacggcagcugguggaaacuagacagaucaccaaaaacgucgcccagauuuugcaucaaaaguacaauaacgagcagcucucugaaaaacccgugaggguaauaacacuuaagagcgcucuagcaucccaguuccguaaagacuuuucacuguauaagauccgcgagcucaaugauuaccaccaugcccaggacgcuuaccugaacggggugauugcccaagcacuuuugaagguuuauccgaaacuggagccugaguucgucuacggcgaauaucagaaggugagcauccgggcguuaaauaaagccacagcuaagaaagaauuuuacucuaacauuaugaauuucuuuacuuccgaugagaugguggccaacgaagagaccggagagguccucuggaauagacagagggacaucaagacgauaaagaaaguuaugaacuaucaccaaaugaauaucgugaagaaaguggaaauucagaccggcgcauucacaaaggagaguauccugcccaaagggccaagcaagaaacuuauugcucggaaaaacaauugggccccuguaaacuacggaggugucgacucucccacuguggcauauuccguuaucauaacccacgaaaagggcaaagccgcuaaggugguccagcagcugguggggauuaaaauccuagagcgacaagcguuugaacaggaugagguugccuuccucgaggaaaagggauuuauccauccaaaagugcagcugaaguugcccaaguacucacuguaccaguucgcagacggccgcagaagguuacucgcuagugccgaggaaagccaaaaagguaaccagaugguacugccuguccaccuuauugagcuguuguaucaugccaagcacgugucggauuccucugggaaaagccucgaguaccugaaugaacaccggcaugaguucgcugaacuacuggaggcaauacuucaguuuacagaacaguauaucgacgccggcaagaaccagaaaaaggugcgagaucucuacgagaagaaucaagacgcggauaugagagagcuggcuucaaguuucauucaguugcugcaguuaaacaaacaaggagccccagcagacuuuaaguucuuuggcgaaacuaucccgcgcaggcguuauaaaaauaccgccgagauugucgaugcuacguucaucaaccaguccauaacagggcucuacgaaacccagaagcggcugguuuga

SEQ ID NO: 2939 - RNA, 3984 nt, Artificial Sequence
  Cas9 variant
augaccgagcagcaacagcccuacaacaucggccuggacauugggacaagcuccauaggaugggccgugacugaucagaaugacaagcuccuucacaucagaggucauaacggcauuggggucaggcuguucaaagaaggagagucugcugcagaacggcgcggcuuucgaacgacccguagaagguugucacggcgcagauggagguuacgguuccuggaucgcaucuuugacgccgagcuagcgaagguugauccuaauuuccucgcucgacugaaacagaguaacauuagcccacuugacccgaauaagcaaauguuugguaacauccuguucgaugacccccaguuugaugaccagaaauuccaccagcaauauccuacaauauaccauuugagauccgcccucgcacagccagaugcuccccaggccgacgugaggcugaucuaucuggcacuccaccauaugauuaaguuucgggggcacuucuuaaauggagccgcuguagaaaaguuucacggcggccagcugcaucuugagucugaguuccaagaauugaaccagaucuuuucgaaucagcaacgugaucacgugcagcugcagacuucaagccuagacgaggucgccaccauucucaaagacaaccagcgcacaccuagugauagacaaagggaacuguccgcgcggcuuuucgugccaguugacaagaccaucgauaaagagaauaagaaacuggcaacugaguugcucaaggccgugcugggguuaaaggcuaaauucgacgucauacugggaguggaagccacagauccccaggcauuuaagcuccaguucucuagcgacgauuuugacgauaaaauugcugagcuugccuccgaacugaccgacgaggcgaacgaaaucuugacgguacuacagcgacuguacuucucacucaaucuggccgauauucuuacuaaccgccaaaccaagcagguugcagacaguaucagcacagcuaugaucaauagauaugacgaucauaaacaccaccugaagauguugaaagagcucgaggcccaggugacucaggaacaaagggacggucugaagaaggcuuacaacgaguauauugauggcgacaaaccuaccauagauacauuuuacaccaacgucaagaaaaauuuagacgauucugaacuggccaaccagaucaagucccuaauugaccuccaggcauucaugccaaaacagcggucaaaggagaaugggagcaucccgcaucaacugcaccagcgcgaacuugaucaguugauagaggugcaaggaaaguacuaucccuggcugcucgccgcuaaagacaagcuggaugcgcuuauugcauuuagagugccuuacuaugucggcccaaugaucgaccccaaccagagugaugacccucagaauacgaaauucgccuggaugguuaggaaggaggcuggugaaaucacuccauggaacuuugaggaaaaaguggacaagacaucuuccgccaccaauuucauuaagcguaugacuacaaccgauacguaccuguugggggagcccguacucccgaaaaacagccuguuauaucagcaauuuaccgugcugaaugaacuaaacaagcucaaagucaauggaaaggcacugacaguggaccagaaaaaguaccuuuaugaucauguuugcaagaaacagcggcgagugacuuugaagaaacugucggacugucucgucgccagaggcgauuucccuaugggcgcuaucuuuaccgggacaacugaccagaagaacaugaauaacacccugaaaacauaccaagauuuccaggagauuuucggagacgagauagauaaucccgaccgccagguggauuuugaaaagaugaucgaguggucuaccauuuucgaagacagggagaucuuuaaauuaaagcuggccgagcuuaacugguugacuuccgaacagcucgagcggguaucaaagaaaagauaccaagguuggggcaggcugagucagaagcuacugacgcacaucguuaacgaaaauggggagcgcauuauagaucagcucuggaacacaaaucaaaacuucauggaaaucaugggacaggacagcgugaaacaggcaauucaggagcauaauggcgcgaacgucgcucaaaccgguaucaaugagacuauugacgaacuguauaccuccccacagaacaagaaagccauccgacagauacuuuugguggucgaugacaucaagaaggcagugggguacgccccugcuaauauuaugauggaguuugcccgggaagaucgugacgaucacagacugaucgcaucuagggcucgccaguuagagaaaacauaucaagaaauuagcaagaacugguucgacaaugagucaguuacccaggagcucaaagaucagaucaagaacaaaacuaaguuuacagaccggcuguaccuuuauuucauacagggcggaauugaucuguacacgggccaccccuugaauaucgaccaacucaguuccuaugauauugaccauauccugccacagagcuuucuacuggacaacucucucaauaacagagugcugaccucacaggccgaaaacaggguacacaaggaggaucgacuucccggggaaacugucgcgaauaaaaugcgcccuacauggaagaugaugcgggagcagggauugaugacccaaagaaaauacaacaaucugacauuaaagccagaccagauaaguaaauucaacaauaggggucaguuuaucaaccgucaacucguggaaacucgccagguuauuaagcuggccgcugauaucaugagccagaaguaccaggcagaccaaaccaaaguggucacggugaaggccaaucuuacccaucacaugcgggagaaauucaacuuuuauaaguccagaaauguaaacgauuaccaccaugcuuucgacgccuaucugacacuauucgugggcaauuggcuccugaaagaguacccgaaguugcagcccuauuuuguuuacggggauuucgcaaaaacuggaaccaacaaucugaagucuuuuaacuucuuauauagguuugaacgagaccacaagcucaaugauaaaggcgcgauugacacagauaaggaccagcagcuggguuacaugaaacggaucuaccgcuucaagaaaaugcuugucacuaagcaacuggagaccaacgaaggggccuuguauggccagacgcucuacccugcuccaaagaacgauaaaaagacaagaaaucugauaaacucgaaaaagaauaggcccagcgacauuuauggaggcuacuccaacgagaaugggucauuucuaacccuggugaaacuuaagaagggaaguaaauaugacuaccggcucguggccgucccuguuucuaagaucagcgagaucaaagaauccgagcuggcaacuauugaaaaggcuaucgccccacaguucuugaaaucaagcgguaaguaucgagauuuucagguggugcugucuaagauuuuaauaaaccaaaaaguaaucgacgauggcaugauuuucacaaucggguccaagaguuacaaacauaaugcaaagcaggucgugcucagcgacaacucuauucagaucguuuccacccugucaagaauaagugauaaagagaaacuuaucacuguguuugacgaaauugucgauaucaccagcaaguaccugcccugguauaaggugaaugacguugagaagacaaaaauguuguuccgccaaaugcaggauauugacgagaugaagaaaaucauagauaacucgcucauuggacugcacugcaaugccuccaucacggaccuaggcaaggugggucugucuaaauacugggggagguucguacuuaccgcuggcaucagccucacugucgaugcgcagcugauuuaucagucaccgacaggauuguuugaacaucgugugaaggugagugacuuauga

SEQ ID NO: 2940 - RNA, 3990 nt, Artificial Sequence
  Cas9 variant
augaacaagcagcccuacaauaucggccuggacauugggaccagcuccgugggauggucugccacagagcucgauaacagacuucugcacauaaaaggucauaauggcaucggggucagguuguucaaggaaggagagucagcugcagaccggcgcggcuuucgaacuacgcguagaagguuagcccggcgcaaauggagacugaggcuacucaacgaaauuuucgcgaccgagaucgcuaagguugauccuagcuuuuucgcccggcugaaacaaaguaauguguccccaaaggacccgaacaagacaauguuugguaauauucuuuucgaugacgaaaaccuggaugaccagaaauuucaccaugauuauaagacuaucuaccacuugcgccaggcaauaaucaaucaucccgagcagaaauucgacauucgacucaucuaucuggccaugcaccacauuaucaaguacagagggcauuuucugaaccaagcuaauguacaggauuucaaaggaggcaagauagaccucgagaagucuuuuaaagcauuaaacgauauuuucgaaaaucagggcagggaccugcggcuugugaccgacgaggccaaccaguaugucaagguguugucggauaaugcuaaaacacguucagaccgcaagaaagaacugagcaagcuacucuacguuccuaucgauaaagacaccgauaagaacaguaagaaagugacuggggagauucugaaggccauccuuggaaacaaagcgaaguuugacgucaucuucgguauugagguggaaaauccaaaagaguggguacugacauucaacuccgaugacuuugaugacaagauagaaggcuugucuagccaaaugaccgaugaggacuccgaaauccuccugauuuuaaaggagcuguauuucgcacucaaucuuucagacauccugaacaauaguguuacggauaaaaacgccaagacuuugagcgaggcuaugauaaauagauacgacgaucacaaaaaccagcuagccaugcugaagaaagugauugacucuuccgauaagaagcaugcaaaagaacucaaggaggcuuacucagccuauaucgacggggaaaauaacaaaaagaucagcuuugaggaucugaaaaagaggauucagaagaaucuugucgacagugaacugucucagaaaaucaacgauuugcucgaccacgauuacuuccugcccaagcaacgguccaaagagaauggagcgauuccucaccaguuacagcaacaggagcuggaccagauaaucgaaagccagaagcaauauuacccauuucuagccgagcucaaccccaaugaaaaacgaucgcgccaggcaaaguauaaacuggaugagcuuguggcuuucagagugucuuacuaugucggcccuaugguugaagugaccgacuccaaccaggagaacaaugguaaguuugccuggaugauuaggaaggagcagggggaaaucacaccauggaacuucgacgagaaaguagaucggacugaaaccgcuacaaaguuuaucacccgcaugacgacuacagacaccuacuugauuggagagccggugcugcccaaaaauucacuccuguaccaaaaguucgucgugcuuaacgagcugaauaacuugaaaauaaaucaggaaacuaucacaccuggccagaagcaguaucucuacgagcauguuaugaagaaaaacaagagagugacccugaaaaagauugccgaugcauuagucaucaaaggcgacuauccauacgcccccgaagugaaggggacgaccgaucaaaagaaucugaacaauggacuaacaacuuauauugaccucgcuaaaaucuuugguaacgagcuggaugacguagauagggaagcggacuucgagaagauaaucgaguggaguaccauuuuugaagaucagcacaucuucguucuuaaauugcaggagcugaaguggcucacagaaaaacagcguaaucaaguggucaagcugcgguaccagggcugggggaaguuaagcaaagagcugcuugcaggauugguggacgauaacggccagcgaauuaucgaccuccugugguccgacaaucaaaacuucaugcagauagucaaccagaagucuuuuaaagaaagcauugccgaucauaauggugcucaccuagaggagaagaaccugaaagacgugaucaaugaucucuauacuucaccucagaacaagaaagccauuagacaaguuauccuggugguagacgauauaaucaaugcagucggguacgaaccagccaacauuaugauggaguucgcuagggaagacaguaaugaucaucgccuuaccaacucccggagcagacaguuggagaauguguacaaggacaucacaaacucuugguuugauaaugacucaguuaaggaugaacuggaggacaaaauuaagaacaaagacaaguucaccgauagguuauaucucuacuuuacucagggcggaaaagaccuguauacgggcgagccccuuaauaucgaugaccugaguagcuacgauauagaccacauuuugccgcaguccuucauccucgauaacucucuggacaaucgcgugcuaacaucgcaacgaaacaaccgggucagcaaggaagaucagcugccuggggagcucuuuggaaccaagaugcacgccuucuggaaacgucugaaggcagcgcaucuuaucuccaauaaaaaguauuacaacuugacucugacccccaauucaauuaguaaauuuaacaaucaggguagauucaucaacaggcaguuaguggaaacacgccaaguaauuaagcucgcugccgagauacugcacaaucgguauucugaggaaaagggcaccaacaucgugacuauuaaagcaaaucuuacacaucacaugagagagaaguuuaacuucuacaaaaauaggaacguuaaugacuaccaccaugccuuugaugcuuaucugacggccuucgucgggaacuggcuacuccagcaguacccaaagcugaaaccuuauuucguguacggagacuuugcaaagaccgaaaucaauaaccuaaagagcuucaauaugcuguauaaauuugagcaagcucaccaguuaaacgaaaaggauggcaaaauugccaaggacacugacgcgcuccuggguuacaugaaaaacguguaucauuucaagaagaugcuugucacaaaagagcuggagaccaaucacggggccuuguuuaaccagacacucuaccccuccccagcucaugauaucaagaaacgacagcugauaaagcccaaagacaaucgcccuacugauaucuacggcggauauacccacgaggaacggaaguacaugucauugguuaaagugauuggcaagaaggacaacgaauauagaauggcaaaugugccacugcuuaaaaucaacaagaauaacgauauuaaagagauccucaagagccaauucucuaauaaaaaguuugaaauaguacugccgaaggucuugaaaaaccagcuguucuccgagaauggggccuuauuugugauuggaaguaaggguuacaaauauaacgcuaaucagcucguucugagcgaccuugauaugaagcuguugaacgaccucucuaauaacaaauccaucgaugaggugacgaucaaccagcuguucaagaauauugucgacucaaccaacaaguacaugccccuauaugaaaucaaaaaucugaacgaggugguugaaaaguuuaauaaccuugaguucaaugauaaaaagaaaacaauaacugacuuccuccuggccacccacgcaaacccuacaaugaguaauuugaagaacauuggcuuaccauacuuugggagguucauccguaauacuggaauuaagcugagcgaaaacgcgaaugugaucuaccaaucgcccaccggccucuuuucccgcaaaauaaagaucucugauuucuga

SEQ ID NO: 2941 - RNA, 3993 nt, Artificial Sequence
  Cas9 variant
augaagaacgacuacaccaucggccuggauauugggacaaauagcgugggauauuccgucguuacugacgauuacaaagugauaucuaagaaaaugaacguauucgguaauacggagaagaaaucaaucaagaagaacuuuuggggcgugagacucuucgaaagugggcagaccgcccaagaggcuaggaugaaacggacaagccgccgacguauugcaagaaggaagaaucggaucugcuaucuucaggaaauuuuucagcccgagaugaaccaccuggacaauaacuucuuuuaccgcuugaaugaauccuucuuagucgccgaugacgcgaaauaugauaagcauccuaucuuuggaacucuggacgaggagauacacuuccaugaacaguuuccaaccaucuaccaccuaagaaaauaucucgcugauggcgacgagaaggccgaucugaggcuuguguaccuggcaauugcccauaucauuaaguuccgggguaacuuuuugaucgaaggggagcucaauacagagaacaauucuguuauagaacugucgaaaguguucguccaacuguacaaccagacccucucagaguuagaaggauuucaguucauugacgagagcaucgauuucagugaagugcugacucagcaacuuuccaagucugagcgcgcugacaauguauugaaacuguuuccggacgagaagggcacaggcauuuucgcacaguuuaucaaacuaaucguugggaaccagggaaacuucaagaaaguguuucagcucgaagaggaucaaaagcugcagcuuagcaccgacgauuaugaagagaauauugaaaaccuguuggccauaaucggugacgaguacggcgauauuuucgucgcugcccagaaucucuaucaagcgauccuguuagcagggauacugacguccacugagaagacccgagccaaacucucagcuaguaugauucagagauacgaagaacacgccaaggaccuuaaacuguugaagagguuugugaaagaacacauccccgauaaguaugcagagaucuucaacgacgcuacaaagaauggauacgccggcuauauugaugguaaaacuaaggaagaggaguuuuacaaauaccuaaagaccacacuggugcagaaaagcggguaucaguacuucaucgaaaagauugagcaagaaaacuuucuccggaagcagcguauauaugacaauggagucaucccucaucagguucacgcggaggagcugcgcgccauucuuagaaaacaggaaaaguacuauucuuuccugaaagagaaccaugaaaagaucgagcaaaucuuuaaagugaggauuccauacuauguaggccccuuggcaaagcacaaugaacagucccgguucgcuuggaacauacgaaagucagaugagccuauccgcccauggaauaugaacgacguggucgacgagaaugccagcgcuguggccuucauugaaagaaugaccaucaaagauauuuaccucaacgagaauguucugcccaggcacaguuuaaucuacgaaaaguuuacgguguucaacgagcugacuaaaguccuauaugcagacgaucggggcguguuucagcgcuucucugccgaagagaaggaggacauauuugaaaaacucuucaaguccgagagaaaaguaacaaagaagaaacuggaaaacuaccuuaggaucgaguugagcauuucgucuccuuccguuaaggggaucgaggagcaguuuaaugcuaacuucggaaccuaucuggaucucaaaaaguuugacgagcugcauccauaccuugaugacgaaaaauaucaagauacucuggaggaagugauuaaggucuugacaguguucgaggaccguucaaugauccagaaucagcucgagcagcugccguuaaaccugaguaccaagacgauaaaagcgcuaagccggcgaaaguacaccgguuggggcagacucuccgcaaggcugauugaugggauccacgacaaaaauucuggaaagacaauucuugauuauuugaucgaagacgagagcgacucauacauagucaaccgcaauuuuaugcaacugaucaacgaugaccaucucaguuucaaaaagauuaucgaagauucccagcccuacaaggagcagcaaagcgccgaagagauugugucugagcugucaggcaguccugcuaucaaaaaggguauauuacagagccugaaaauuguugacgaacuuguggccaucaugggguauaagcccaaaaauaucguagucgagauggcacgggaaaaccagacuaccggcagaggaaagcaaaauuccaagccaagguugaaaggcauugagaacgggcucaaggaauuuucugauucggugcugaaaggaagcuccaucgacaauaagcagcuacagaacgaucgccuguaccucuauuaccugcagaaugguaaagacauguauacaggccacgagcuugauauugaccauuugucaacuuacgauauagaccacaucauuccucagaguuuccugaccgauaacucuaucgacaaccgaguuuuaacaaccagcaaguccaaucgggggaaaucagacaacgugccaagcgaggaagucgugcguaagauggauagauucuggaggaagcuccugaaugccaaacuuauuucugagcgcaaguauacuaaccugacgaaaaaggaauugacagaguccgacaaagcuggauuucucaagcggcaacugguagaaaccagacagaucacuaagcacguggccaccauacuagauaguaaauucaaugaggacagcaacaauagggauguucagaucauuacacugaagucugcacucgucuccgaguuucgaaaaaccuucaaccuguacaaggugcgcgaaaucaaugaccuucaucacgcgcaugaugcuuacuugaacgccguggucgcacugucauuacuccggguuuauccccagcugaaaccggaguuuguguacggcgaauaugguaagaauaguauucacgaccaaaacaaggccacuaucaaaaagcaguucuacagcaauauaacaagauauuuugcuucgaaagauuacauuaucaacgacgauggggagauccuuuggaauaagcaggagacgauugcccaagugauaaaaacccugggcaugcaccagguaaacgucgugaagaagguugaaauccagaaaggaggcuucuccaaggagucuauucagccuaaaggggaaagccaaaagcuaaucaggcguaaacagcaguggaacacuaagaaguauggagguuuugacucacccguggucgcauacgcuauucuccugaguuucgacaaaggcaagcgcaaagcccgguccuuuaagaucguggggauaacaauccaggauagagagucuuucgaaggaaauccaauuuuguaccugagcaaaaaggacuaucauaacccuaaaguugaggcgaucuuacccaaguacucccucuucgaguuugaaaauggcaggcgacggaugguggccucagcuagcgagacccaaaaggguaaccagcugauuaucccagggcaccuuauggaacuguuguaucauaguaaaaagauaauuaauggcaaaaacucugauuccguaagcuacauccagaauaacaaggagaaauuccgcgaaaucuuugaguauauugucgacuucucgucaaaguacaucucugcagaugccaaucucaacaagauagagaaaauuuuugaaaauaacuuccacaaggcuagugagcaggaaaucgccaaauccuuuauuaaucugcuaacauucacugcaaugggagcgcccgccgacuuugaguucuuuggcgaaaagaucccuagaaaaagguaugugagcauaucugagauuaucgaugcuguguucauccaucaaagcauuaccgggcuguacgagacgcggguccgacuuaccgaaguuuga

SEQ ID NO: 2942 - RNA, 3993 nt, Artificial Sequence
  Cas9 variant
auggagaaggaauacaccaucggccuggacauugggacaaacagcgugggaugggccguccucacugaugacuauagacuuguugcuaggaaaauguccauacagggugauucuaaucggaagaaaaucaagaaaaacuucuggggcgcacgccuguuugaggaagggaagacggcccaauuccgacguauuaagagaaccaauaggcggcgcaucgcgagaaggcggcagcgcguguuggcuuuacaggacauuuuugccgaggaaauccacaaaaaggaucccaacuucuuugcacgacuggaggagggagacagaguagaagccgauaaaagguucgcuaaguuuccuguguucgcaacacuaucagaggaaaagaauuaccaucggcaguauccaacuauauaccaccuccgucaugaccuggccaacaguaaggagcaagcugauauccgccuugucuaucuggccauugcgcacugcuugaaguacagaggccauuuucucuucgagggugaacuggacaccgagaauacaagcgugaccgaaaacuaucagcaguuucugcaggcauaccaacaguucuuuccggagcccaucggggaucucgacgaugccguuccuauuuuaacugaaaggcuguccaaagcuaagcggguggagaaaguccuugccuacuauccaucugagaagucgacaggaaauuucgcacaguucuugaaacugauggugggcaaccaggcuaauuuuaagaaaaccuucgaccuagaagaggaaaugaagcucaacuuuacgcgagacuguuacgaggaagaucugaaugagcuucuggagaagacuucagacgauuaugccgaauuguuccucaaagcgaagggcguauacgacgccauccuguuaagccaaauacugaguaaauccgaugacgagaccaaggcaaaacucucugcuaacaugaaacuucgcuuugaggaacaccagagagaucugaagcaguugaaagagcuaguuaggcgggaccugcccaagaaauaugaugacuucuuuaagaaucgcagcaaaaacggguacgccggauaugugaaggguaaggcuacacaagaagauuucuacaaauuucucagaacugagcuggccggccuugaagagucccagucaauuauggaaaagaucgaccuggagauuuacuugcucaaacagaggaccuucgcaaacggggucaucccucaccagauccaucugguggagaugcgugaaauuauggaccggcaaaagcgauuuuauccauucuuaaaaggagcccagggcaagauagagaagcugcuaacauuuagaauccccuacuauguggguccucucgcucaggaagggcagaguccauucgcguggauuaaacgcaagagcccgucucaaaucacccccuggaauuucgcagaggucguugauaaagaaaacuccgccauagaguuuauugagaggaugacgaaucaggacacuuaccugccuaaggaaaaagugcuuccaaagcagucauugaucuaucagcgguucaugaucuuuaacgagcugacaaaaguaagcuacaccgaugaaagaggaaagagucacuauuucucuuccgagcaaaagaggaaaauuuuuaaugaacucuucaagcagcauccccgcgugacugagaaacagcugcgaaaguuucuugagcugaacgaacagaucgacagcacagagauuaaaggcauagaaaccucguucaaugcuucuuacuccacguaccacgauuugcucaagcugucagaccaaauggauaccuuacuggacgauccugacaugacaacuauguuugaggaaaucauuaagauccuaaccaucuucgaggaucgggagaugauucgugaacagcucaaaccauaugagacaguccugggccuucccgccauaaagaaauuggcaaagaaacacuacacuggguggggaagacugagugaaaagaugauccaggguaugagggagaagcaaagccgcaaaaccauucucgacuaucugaucgaugacgacgauuuuccgugcaaccggaauagaaacuucaugcaguuaauuaaugacgaucaucuguccuuuaaggagacaaucgccaacgaacuuauaaugucugacagcaauguguugcucgaucagguuaaagcuaucccuggcucacccgccgugaagaaagggauuuggcagaguaucaagauugucgaggaaaucauaggaauuaucggcaaggcacccaaaaacauugugaucgagauggcgagggaaaaucaacgaaccucccgcagccggccuagacugaaggcucuagaggaggcccugaaaaacauagacucuccccuccugaaggauuacccaacugacaaccaggcacuucagaaagauagguuguaucuguacuauuuacagaaugguaaggacauguacacgggggaaccccucgagauccaccgucugucagaauacgauauugaccauaucauuccucgcaguuucaucguagauaacagccuugacaauaaaguucugguguccucuaaggucaaccggggcaaguuggacaaugccccagauccgcucguggucaaaagaaugaggucgcacugggagaagcugcaucaagcuaaacuaauaagcgacaagaaacuggccaaccucacaaagcagaaucugaccgaagcagauaaggcucgauucauucagcggcagcuuguggagacucgccaaaucaccaaacacguugccaacuugcugcaccagcauuuuaauuuacccgaggaaguguccgcgacagagaagaccucaaucauuacucucaaaaguacacugacgucucaguucagacaaauguuugacaucuauaagguaagggaaauuaaccaccaucaccacgcccaugaugcuuaccuuaauggagucguggcaaugacccugcucaaaaaguauccuaagcuagccccagaguucguuuacggcagcuauauaaaaggggacaucaaccagauuaauaaggcuacugccaaaaaggaauuuuacuccaacaucaugaaauucuuugagucagaggaaauuaucugugaugagcagggagaagugauauggaauaagaagcgggaccugagcacaaucaaaaagaccauuggugcacaccaggucaacaucgugaaaaagguagagaaacaaaagggcggguucuauaaggagacaauuaacucuaaagcgaaucccgaaaaguugaucccucgaaaagccucccuggauccauuaaaguacggaggcuacgguaguccccucguggcuuauacuguuauauuuauuuucgagaaagggaagcagaaaaaggucaccaagggcaucgaaggaaucacggugauggagcagcugagauuugaacaggacccgcgcgaguuccuuaaaaccaagggcuacgagggggugaaacaauggcugauuuugccuaaguauauacucuucgaagcccagggagguuacaggcguaugaucgcaagccaucaggagacacagaaagcuaacucucugauucuaccagaaaaucuggucacucuucucuaucacgcccggcauuacgaugagaucaaccacaagguuuccuuugacuaugugaaugcacacaaggaaggcuucaacgacauuuuugauuucaucucagacuuuggggugagauacauacuggccccacaacauuuggagaaaaucaagguagcuuacgagaaaaauaaggaagucgaucugaaagagaugauugacgcgaucuuaagucuccugaaguucacccuuuuuggagccagcguggaguucaaguuuuucgauauuaaaauccugaagagguauaaaucguugacagacauaugggaagcaacuauuaucuaccaguccguuaccggccucuaugaacgccgaguggaggucagaaagcugugggauggugagcggcuauga

SEQ ID NO: 2943 - RNA, 3996 nt, Artificial Sequence
  Cas9 variant
augaacaagcagcccuacaauaucggccuggacauugggaccagcuccgugggauggucugccacagagcucgauaacagacuucugcacauaaaaggucauaauggcaucggggucagguuguucaaggaaggagagucagcugcagaccggcgcggcuuucgaacuacgcguagaagguuagcccggcgcaaauggagacugaggcuacucaacgaaauuuucgcgaccgagaucgcuaagguugauccuaguuucuucgcccggcugaaacaaagcaauguguccccaaaggacccgaacaagacaauguuugaaaauauucuuuucgaugacgagaaccuggaugaccagaaauuucaccaugauuauaagacuaucuaccacuugcgccaggcaauaaucaaucaucccgagcagaaauucgacauucgacucaucuaucuggccaugcaccacauuaucaaguacagaggucauuuucugaaccaagcuaauguacaggauuucaaagggggaaagauagaccucgaaaagucuuuuaaagcauuaaacgauauuuucgagaaucagggcagggaccugcggcuugugaccgacaaggccaaccaguaugucaaaguguugucggauaaugcuaagacacguucagaccgcaaaaaggaacugagcaaacuacucuacguuccuaucgauaaggacaccgauaagaacaguaaaaaggugacuggcgagauucugaaagccauccuugggaacaaggcgaaauuugacgucaucuucggaauugagguggaaaauccaaaggaguggguacugacauucaacuccgaugacuuugaugacaagauagaagguuugucuagccaaaugaccgaugaggacuccgaaauccuccugauuuuaaaagagcuguauuucgcacucaaucuuucagacauccugaacaauaguguuacggauaagaacgccaaaacuuugagcgaggcuaugauaaauagauacgacgaucacaagaaccagcuagccaugcugaaaaaggugauugacucuuccgauaagaaacaugcaaaggaacucaaagaggcuuacucagccuauaucgacggcgaaaauaacaagaaaaucagcuuugaggaucugaagaagaggauucagaaaaaucuugucgacagugaacugucucagaagaucaacgauuugcucgaccacgauuacuuccugcccaaacaacgguccaaggagaauggggcgauuccucaccaguuacagcaacaggagcuggaccagauaaucgaaagccagaaacaauauuacccauuucuagccgagcucaaccccaaugaaaagcgaucgcgccaggcaaaauauaagcuggaugagcuuguggcuuucagagugccuuacuaugucggaccaaugguugaagugaccgacucuaaccaggagaacaauggcaaguuugccuggaugauuaggaaagagcagggugaaaucacaccguggaacuucgacgagaagguagaucggacugaaaccgcuacaaaauuuaucacccgcaugacgacuacagacaccuacuugauuggggagcccgugcugccuaaaaauucccuccuguaccaaaaauucgucgugcuuaacgagcugaauaacuugaagauaaaucaggaaaucauuacuccaggacagaagcaguaucucuacgagcauguuaugaaaaagaacaaaagagugacacugaagaaaaucgccgaugcauuagucauuaagggcgacuaucccuacgccccugaagugaagggcaccacggaucagaaaaaucugaacaaugggcuaaccacauauaucgaccucgcuaagauauuuggaaacgagcuggaugacguagauagggaagcggacuucgagaaaaucauugaguggucaacuaucuuugaagaucagcacauuuucgcacuuaaguugcaggagcugaaauggcucaccgaaaagcagcguaaucaaguugugaagcugcgguaccaggguuggggcaaauuaaguaaggagcugcuugccggguuggucgacgauaacggacagcgaaucauagaccuccuguggagcgacaaucaaaacuucaugcagauugugaaccagaaauccuuuaaggaaucuaucgcugaucauaauggcgcccaccuagaggagaaaaaccugaaggacgucauuaaugaucucuauacaagcccacagaacaaaaaggcaaucagacaagugauacugguuguggacgauaucauuaaugccguagguuacgaacccgcuaacaucaugauggaguucgccagggaagacucaaaugaucaucgccuuacuaacagucgguccagacaguuggagaaugucuacaaggacauuaccaacagcugguuugauaaugacucugugaaagaugaacuggaggacaagaucaaaaacaaggacaaauucacagauagguuauaucucuacuuuacccaagggggcaaggaccuguauacuggagagccgcuuaauauagaugaccugucaaguuacgauauugaccacaucuugccucagagcuucauccucgauaacucccuggacaaucgcguucuaacgucucaacgaaacaaccgggugucgaaggaagaucagcugcccggcgagcucuuugggacaaaaaugcacgcauucuggaagcgucugaaagcggcucaucuuauuagcaauaagaaauauuacaacuugacccugacuccaaauuccaucucaaaguuuaacaaucagggaagauucauuaacaggcaguuagucgaaacccgccaagugauaaagcucgccgcagagauccugcacaaucgguauagugaggaaaaagguacaaacauuguaaccaucaaggccaaucuuacucaucacaugagagagaaauuuaacuucuacaagaauaggaacgugaaugacuaccaccaugcuuuugaugccuaucugacagcauucguuggcaacuggcuacuccagcaguacccuaaacugaagcccuauuucgucuacggggacuuugcuaagacggaaauuaauaacuugaaaucuuucaauaugcuguauaaguuugagcaagcccaccaguuaaacgaaaaagauggaaagaucgcgaaagacgccgacgcucuccugggcuacaugaagaacguguaucauuucaagaaaaugcuugugaccaagaaacuggagacuaaucacggugcauuguuuaagcagacacucuacccaagccccgcccaugauauaaagaagcgacagcugaucaaaccuaaggacaaccgcccaaccgauauuuacgggggcuauacacacgaggaacggaaguacaugucccuagucaaaguuaucggaaagaaagacaaugaguauagaauggcuaacgugccgcugcuuaagauuaauaaaaacaaugauaucaaggaaauacucaagucacaauucagcaacaaaaaguuugagauugugcugcccaaaguauugaagaaucagcuguucucugaaaacggcgccuuauuugucaucggguccaaaggauacaaguauaaugcaaaccagcucgugcugagugaccuugauaugaagcuguugaaugaccucagcaacaauaaaucuaucgaugagguuacuauuaaccagcuguucaagaacauaguggacuccaccaauaaauacaugccucuauaugagaucaagaaccugaaugaagucguggagaaauuuaacaaucuugaauuuaacgauaagaagaaaacgauuaccgacuuccuccuggcgacacacgccaauccaacuaugucaaacuugaagaauaucgguuuacccaguuacuuuggcagguucaccagcgggaacgcuggaauuaaacugucggagaaugccaacguuaucuaccaauccccuacaggccucuuuucucguaaggugaaaauaagcgauuucuga

SEQ ID NO: 2944 - RNA, 3999 nt, Artificial Sequence
  Cas9 variant
augaagaacagagagaauaucaaauacuauauuggcguggacauagggaccaacagcgucggaugggccguuaucgaugaaaaugguaaccugcucaagaaaggcaagcaccaucuuuggggguccaggcuguucgaccaggcucaaacagcacagaaucggcgcaacuaccgaucuucacguagaagguauaauaaacggcgccagagaauuggauuguuaaggcugaucaugagugauauggugcuagagguagaccccagcuuuuucauucggcucgaaaagacuacguuucuggauaaggaggacaaaaaggccauccuuaaagauaacuacaagaugaauuauaaccuguucugcgacgaagauuacaaugacaaaaaguauuuuaaggauuacccuaccauauaccacuugcgcaaaaagcucugugaguccgacgagaaagcggauccacgacugaucuaucuggcucuccaucacauugugaaguacagaggcaacuucuuauaugaaggucaggagcugcaucuugaaccgucuaauaaagaggaggacuugaagauccuguuugacauucuagggaaaaacaaugauacagucuacgacaucucggaagaacaaauacaguucauucucaagacugugguugaaaacaucucaaagaccgccaaaguggaugagugcaugagccagcugaaacuuaacagugaagacaaaaagauugucaaagaguuuaugaggggacuggugggcaauaaguucaacguauccaaguuguauaugcacgaggaucuccaguuugacgaugaagaccugaaauuacaauucucugauaagagcuacgaggaaaagaucacagaguaugaaaauguucuggaggagaagauggaauuuaucgaccucaugcagcgguucuacuccuggauugagcuuucaaaaauagugggcagugauagccagcacgcaucuaucuccggggccauggucaacauuuacgaaucacaucgugaggaccugcgcaccuugaaggaagugaugcuaaagaucgguaaaaaggaguaugacgagauguucaaacccacuagcaagaauguggucaacuacuauaauuacguuaacccuguggcuuguaguggagauaaaacagacggcuuuuauaaguacguaaagaaagcaauagaaaagucugaugacuccagaaaagaugagauucugcagaagaucgccaaugaaaccuauaugcucaaacaaacgagcaagaacaaugcuuacaucccauaccagaugcagaaagacgagcugauuaagauccuugaucaccaagagaaguauuaccccgugcugaaagaaaacagggacaagauuauaucgaucuuggaguuccggauuccuuauuacuaugggccacucgauggaaauaaacaguuuggcuggcugaucaagaaaaaggguaaggaaaacgagcgaaucuuacccuggaaucaucaggaaauugucgacgugcaggagacugccgcgcaauucaucaaaaagcugaccaacuacugcacauaucuaccuauagagaaaguuaugccacagaagucucucacuuguuccauguacgaagugcugucagaggucaacaaaauucgcaucgaugggaaacuuuugccgauugacaccaagaauagacugaucgaagaucucuuuuucaaaaggaagacagugaaagagaaggaccugauaaacuggcuuaaacagaaucagcugaccguaggagaaaucacgggcuaccaaaaggagaaggcauuuaguagcuccuuggcccccuggauugacuucaaagagaucuuugaugaaauuaacgacucuaauuaugaucucaucgagaagauaauugaagacaugacuaucuucaacgagggcagcauucugaaagaacgguuaaagaaggcuuacaaucuggaucagaacaagguuaaaaagaucaugaagcuaaaauauucaggguggagucgccucuccaagaaacugauaaauggaaucagagccgacaacaaguuugguagcucugugucaauucuugaugucaugaaagagagucacauggcauugauggagaucauuaaugaccaggaucugggcuucaagcagaucauagaaaaggagaacuuuaaaaaugaaacagggagcuucgaguacgaggacauugaaaaccucgcuggauccccugcccugaagaggggcaucuggcaaaccuuacaggugaucgaggaaauuaaaaauuauaugggucacgagccaaagaacaucuacauugaguucgcgcgugaggagcaggaaaaaguccggacuacaacccgagugaagaagcugaaaucuauauauaacgauaucaagaaucagcuugacguucaugggaaagagguguacucgaacuugaauaagcaagaugagaaaagcuccauugaaaagagacucuaccuguauuacacgcagcuaggcaagugcauguauucaggagaaagucuggacaucgacaaacucucuaacuacgagauugaucacaucuuucccaggacccugacaagcgacgauucccuugacaauuugguacuggucaagaaaaaggagaaccagcgcaaauuagaugaccucgugcugccucuugaaauacggaauaagauggagguuuucuggaagaaacuguaugauaacggcuugaucacucaaaccaaguacuauagacucaugagggacgaauuucgccgagaucagauugacaaauucaucaaucggcagcugguggagacacgucagauuaucaagcaugucgccaacauaauugaaaaucacuacgaggauacuaaaguguuuaccguaagagcaaaccuaucacaugaguucagggaaaaguacgggaucuauaaaaaucgcaacgugaaugacuuucaccacgcucaugacgccuacaucgcuuguauuauaggacgguauauccaaauuagauucccaggucuggaggccaaguacguuuauggccaguacaugcagaacgucaagaaaacaaagaacaauaucgauaaagaaaaccacggguuuauuaucaauagcaugaaguaugagugcauagacgaggauaccggagaagugaucuggaaccccgagaggauucucgacuacaucaaauguuucaauuaccgagauguguauauuacuaagaagcuggacacgaacaaucgcgaacuuuuuaacgucacaaucuugccgaaugauaaaaacucugagaagggcaaaaccaaggcaacuauaccuguuaauaaacugcgguccaacgugagaaaguacgguggguucaguggcuuacagagcgacauuguggccaucgaaggaaagaaaggcaagaaaaucgauaggcgucucauuaaucugcccauccuucugcgcuauguaucuauagaggaccaaugcaaguacauuauggagaacaauaaauauuccgaugucaagaucauuaagaaaaucaagaaaaaccagcuaauagaaauugacgggaucuguuacuaucucaagucagcugaugagcuggacaccgcguaccaguugauccugagucgggacgauaaugaaaugauuuacagaaucgacagggcaauucagaacaacgauuuuagcuauuucgacaauaaaaaggagaacauagaugaauuauaccgacucaucugccauaaaaugauugagaauuauccaaaguacaagaaaaagguguaugaguucaucaaagaacgggaggaagaguuuuucgaacuggacaacucgcaaaagugcaucguuauuuuugagaugauacgcgugaugaaaagaggagagcaguacaucaauauuccuuucgaacccuauaaccuuaagaaugauaggaagggucggcugaacugucaguccaucuugcucgacaauacauacuuuuacgaugucucuauuaccggcaucuauagcaaaaaguacaaacuguga

SEQ ID NO: 2945 - RNA, 3999 nt, Artificial Sequence
  Cas9 variant
augcagaagaacuacaccaucggccuggacauugggacaaauagcgugggaugggccgucaugaaagaugacuauacucucauaagaaagaggaugaaaguucuugguaacacggauaucaagaaaauuaagaagaauuucuggggcgugcggcuguuugacgagggggaaaccgcuaaagagacacgcuugaagcgaggaacucguagaagguaccaacggcgcagaaacagguuaaucuaucugcaggauauuuuccagcagcccaugcuagcaaucgacgaaaauuucuuccaccggcucgaugacuccuuuuucguaccugaugacaaaucuuacgaucgccauccaauauuuggcucacuggaggaagagguggccuaucacaacaccuacccgacaaucuaucaucuucgaaagcaccuggcggacaaucccgagaaagcugauuugagacucgucuacaccgcccuggcacauauugugaaguacaggggucacuuccugaucgaaggggagcucaacacugaaaauacaaguauuagcgagaccuuugagcaauucuuagacacguauuccgacaucuuuaaggaacagcugguuggagauauaucuaaaguggaggaaauucuuucgucaaagcagagccggagucguaaacacgagcagaucauggccuuguucccuaacgaaaauaagcugggcaacuuuggccgcuucaugaugcuaauugucgggaauacuuccaacuucaaaccaguguuugaccucgaugacgaguacaagcugaaacuuucugaugagaccuaugaagaggaccuggauacauugcucggaaugacugacgauguauuccuggacguuuuuauggcugcaaagaauguguacgaugccgucgaaaugagcgcuaucaucuccaccgacacagguaacucaaaggccguguuaaguaaccaaaugauuaauuucuaugacgagcauaaaguggaucuggcgcagcucaagcaguuuuucaaaacccaccuucccgacaaguacuaugaaugcuuuagcgauccuucuaaaaacggcuacgcaggguacauagacggaaagacgaaucaggaggauuucuauaaguacaucgagaaagucaugaagacuauuaaauccgacaagaaagauuauuuucuggacaagaucgauagagaaguuuucuugaggaagcaacggucauuuuacaacagcgugauaccacaucagauucaccuacaggagaugcaagccauccuggaccgacagagucaguauuaccccuuccucgcugaaaaucgcgauaaaaucgagucucugguaacauuuaggauuccuuauuacgugggcccacuuaccgucuccgaccagagcgaauuugccuggauggagagacaaucggaugagccgauccggcccuggaacuucgacgaaauugugaauaaggagcgcucugcagaaaaauuuauagagagaaugacuaacauggacacauaccuguuggaggaaaagguucucccuaaaaggucccuguuauaucagaccuucgagguguacaaugaacugacgaagguccguuauaccaacgagcaggguaagacagaaaaacuaaaucggcagcaaaaggcugagaucauugagacucucuuuaaacagaagaaccgagugagagaaaaagauaucgccaauuaccuggagcaguauggguacguagacggaaccgauaucaagggcguugaagacaaauucaacgcgucacuuaguacauauaaugauuuggccaagauugacggcgcaaaggcuuaccuggaugacccagaguacgccgaugugugggaagacauaaucaaaauucucacuaucuuugaggauaaggcuaugaggaaaaagcagcugcaaaccuauagcgacacacuuucccccgagauucugaaaaaguuggaacgcaagcacuacaccggguggggacgguucucuaaaaagcucaucaacggucugagagaugagggcagcaacaaaacuauauuagacuaucugaagucagacgaagggaguuccggaccuacgaauaggaacuuuaugcagcuaauccgcgauaauacacucagcuucaaaaagaagauugaggacgcccagaccaucgaagauacuacccauauuuacgacacagucgcagagcugccaggcucucccgccaucaaaaaggguauacgacaggcucuuaaaauuguggaggaaaucauugauaucauaggguaugagccggaaaacaucgucguggagauggcgcgggagucacaaaccacuaagaaaggcaaggacuugaguaaggaacgucuggagaaacucacagaagcaauuaaggaguuugauggaccuagcgacguuaaagugaaggaucugaaaaaugaaaacuuaagaaaugacaggcuguaccuuuauuacuugcagaacggccgcgauauguacacgaaugagccccucgacaucaacaaucuguccaaguaugacauugaucacaucauaccacagucuuucaccacugacaacucgauugauaauaaaguccuaguaagccggacaaagaaccaagggaauaaguccgacgaugugccuucaaucaacaucguucauaaaaugaagcccuuuuggagacagcugcacaaagccggacucauuagugacaggaaguucaaaaaccugaccaaggcugagcaugguggccuuacagaagccgaucgagcacacuuuuugaaucgccagcugguggagacucggcagaucaccaagcacgucgccaacuuacucgacucucaauacaauacggcugaagaacagagaauuaacauagugcugcuuaaaagcuccaugaccucaagguuccguaaggaguucaaacuguauaagguacgcgagaucaaugauuaccaucacgggcaugacgccuauuugaacgcagugguugcgacaacuauuaugaaagucuacccaaaucucaagccccaguuuguguauggacaguacaagaaaaccagcauguucaaggaggaaaaagcuacagcccggaagcacuuuuacucuaacaucacuaaauucuuuaagaaggagaaaguggucaaugaagagaccggcgaaauucugugggauacggagagacaccuauccacaaucaagaggguucugaguuggaaacaaaugaacauagugaagaaaguggagaagcagaagggucagcucuggaaagaaaccaucuauccuaagggggacagcucuaaacugauuccaguaaaggagggcauggauccgcagaaauacggaggccuuucccaagucucagaagcauucgccgugguuaucacucaugagaaggggaaaaagaagcaguugaaaagugaccugauuagcauccccauaguggaccagaaggcuuaugagcaacacccuacagccuacuuagaagaggcaggauauaauaacccaaccguccuccaugaacuguuuaaauaccagcuuuucgagcuggaagaugguucgcgacggaugauugcuuccgccaaggaguuucagaaaggcaaucagauggugcuaccccucgagcugguugaauugcuguaucacgcgaaccgcuacgacaaggugaaguucccugauucuaucgaguacguacaugacaauuuagccaaauuugaugaccuccuggaauaugucaucgauuucagcaacaaguacauuaacgcugacaaaaaugugcaaaagauacagaaaaucuauaaggagcacgggacugaagauguggagcuuaccgucgagucauucguuaaccugaugacauuuacggcaaugggagccccagcuaccuucaaguuuuacggcgaaaguauuacuagauccagguauacaucuaucaccgaguuccgggguagcacauugauuuuucaguccaucacugggcucuacgaaacccgauauaaacuggaggacaauuga

SEQ ID NO: 2946 - RNA, 3999 nt, Artificial Sequence
  Cas9 variant
augaugaaggaguacagcaucggccuggacauuggguccucuucagugggauucgucgccguugaugaccaguauagagugguaagggcuaaagguaagaacgugauaggcacccggcucuuugaugaagggaaaacagcagccgaccgccgaggacuucguacuacgagaaggcggcugagucgcagaaaguggagguugcgguuacugcgcggcaucuucgagccccacauuaaugaaaucgaugagagcuuuuucaugcgacuaaaagaauccaacauuucuccuaaggacucgaauaagcauuuuccaggugauauccucuucaacgacagaucagauagggaguuuuacgagaauuauccgaccauauaccaucugcggcaagcgcuuaaaacagaaaagcgucaguucgacauccgcgagauuuaucuggcuaugcaucacaucgucaaauacagagggcacuuuuuggaaggaggcacugugaccgauuucgagguuggcgagcucgaccuggccgggaaguuuagcaggcugaacgaacucuucgagaguauuaauuuagaagugcccuuuguccugcggcuugauaacuuggaggacgugaaagcaguacugaucgacucccagcgaucugcccaggaucgccaaagaacacuaaccccugacauauauguuccaagcacugauaagauuacagaaaagagguucaaaggaaucgcuaccgagcuccugaaggcaauuguggguaauaaagccaaguucgacguccuugcuggccuggaguuggauaaagaagaggccaagcucugggcgcugacguuugacuccgaaacuuucgaugaggacaucgaacaguuagagggggauaugaccgaggcaacacaggaccugaucgaaauucucaaaucacuucggagucugauacgcuuggccgugaacaugcccgagggagugagccuaucugaaaugaugauccagagauacgaggaucacgcugaccaccugaagcuccugagggacauuauccauaauacugaugccgaaaaggcagcuggccuucaagccgcguacgacgguuauauagauggggucaaaggaaagaaaaccccuguugacgauuuuuacaaggccauuaaaaagaaccuggacgauuccgaggcagcucaccagaucuuggcccucaucgacaagaaugaguucaugccaaaacagcguucaaagagcaacggcuggauuccccaucagauccaacagaaagaacuggaucggauuauagagaaucagaagcaauauuacccuugguuagcugacgugaacccaaacgaaagucgaagaaaaguagccccguauaagaucgaugagcuggugacauuuaggguccccuacuaugugggcccucuaguuaccucugaggaacagaagaaauacggguccaaguucgcauggauggugcgcaaagaggaaaagggagagauuacgccauggaauuuugaccagaaagucgaucgggccgcuagcgcgacugaguucaucaacagaaugacaaccauggacacuuaccuccugaaugaagacgugcuucccgcacacucguugaucuaucagaaguacgagguacugaacgaacucaauaagguuaaaauuaacggugaugccauaacaccugagcugaagcagaaaaucuaucacgaccuuuuugaaaagcaaaccacggugucuauuaaaaaucugcagaccuacuuggucuccgagucagaagcuagugaggugccagagaucaagggccucgccgaugagaaaaaguuccugagcggguuaacaacuuaucaugaccugaugaagauuuuugauaggaacgucgugaaugaccccgaacgcgcagaagauuucgagaaaaucauacgaugguccaccguuuuugaagacaagcacaucuaccgggagaaacuagauucucucagcuggcugacaacugaccagaaggaucgucuugccgugaaaagauauaggggauggggccgcuugucagagaagcugcucauuggucugcgggacgaagggcauagaaguaucauggauuacuuaugggagaccacauccaacuucaugcaaauucaggcucagaaugacuucagcgaaaagaucgccgcagagaacaaagaguuucuggacaauacccagucuguacaaggcauaauuaacgaacuuuacacuucaccgcagaauaagaaagcgaucaggcagacguugcucgucguggaggauauuaagaaggcuuuccacggagaagccccuaaacgaaucuuuguugaguucgcacgcgaaaacgagaguacaccccagcggagcauacaaagacagcgucagguggagaacgccuaugaaaaggucacccaaaaucugcuaguggacgauaaaaucagggcugagcugaaggacuccauuaacgaaaaacgccucuuucaugaucggcuguuccuuuacuuuaugcagggcgggaucgacauguauucuggaaagaaaauuaauaucgauaacuugucggccuacgacauagaucacauucugccacagagcuucacuguagacaauuccuuagauaacagagugcucaccaaucagaaggacaacagggagaaggguaauucacugccuagugaacuuuaucgaggcucuaugaaagagacaugggagaugaugcggaaccaagggcuguugagcaagggaaaauuucaccgccucaugaugacccccaauuccaugacugcauacgaccagcagggcuucaucaacagacagcugguugaaacaaggcaagucaucaagcuagcuguggagauucuggccucagaauuugaucaggcggacgagaaaguggaaaucgucagcguuaaggccggucucacgcaucagaugcggcaggauuucucucugauuaaaaaucgagacgugaacgauuaucaccaugcuuuugacgcauaccuuaccgccuucguggggacuuacuugcugaagagauauccaaaguuacgccccuacuucguauauggcgaguuuaaaaaguucucccaaaaacaggcuaaucucacaaacuuuaacuuccugugggcccuuaagcacaaagaucaggucgcaguggaggacaccggagaaaagauauggaauaagccucaagaucuggcguacaucaggcaccuauuugccuucaaaaagauucucaucagucgugagguuagcgaacggcauggcgcucuguuugaccagacauuguauaaagccucugaugacaaggcauccgggcagggaaguaaaaagcugauuccagcuaaggauaacagaccgacugaguuauacgguggcuauucagggcagaccagcgccuucauggcaaucgugaaagucacgaagggcaaaaagaccaaauaccucgugguuggagugcccacagccgcuauaucgcaacugcaggguauggacguaaaguccucucaguacacugagaagaucuauaauauucuuagcccuaaacuguugucaaagaacgacgauuuugaagucaucgugccaaaagugagguaccgccagcucauucuggacaauaaccaacuauucacccuggggagugauacauauaaguacaaugcgcgacagcuuguccucuccaacgagguucuggccgugaucaauagagacaaaucuuuuauagauaagaaguugagcgaagaggcagaaaaccaggcucugaaugacgccuucgaugagauuguaguggccauggacaaacacuucgauuuauaugacaagaacggcuuucgggagaaagucaaggcuggaaaacagagguucgaggaacuccccgugucccuguuuucagaagauaaggagaaugaaggcaucacuaaacgcaccguucuuaagcguauccugcaaggguugcaugcaaacgccacgacaagcgaccucaaggugcuggauggaaaauucuacaauuga

SEQ ID NO: 2947 - RNA, 4002 nt, Artificial Sequence
  Cas9 variant
augaagaacuacaccaucggccuggacauugggguggccagcgucggauggguuugcauagaugagaauuauaaaauccucaacuacaauaacagacacgcuuucggugugcaugaauuugaguccgcagaaucugccgcgggcaggcggcuuaagcgcgggaugcgacguagauauaauaggcggaaaaagcgccugcaguuguuacaaucacuguucgacaguuacauuacagauagcggauuuuucuccaaaacugacucucagcacuuuuggaagaacaauaacgaguucgaaaauagaucgcuaacggagguacucucaagccugaggaucaguucccggaaguaucccaccauuuaccaucuucgcucugaucugaucgagagcaacaaaaagauggacuugcgacucguguaucuggcucugcacaaucucgucaaauacagaggccacuuuuuacaggaagguaacugguccgaggccgcaucagccgaagggauggaugaccagcugcuugaguuggugacaagguacgcugagcuggaaaaucuaaguccucucgaucugagcgagucucaauggaaggcagccgaaacucuucuguugaaccggaaucucaccaaaacagaccaguccaaggagcugaccgcuauguucggaaaggaauaugagccauuuuguaaauuaguugccggccugggcgugucacuccaucagcuuuucccgagcagugagcaggcgcuggcauacaaggaaacuaaaacaaagguccaauugucuaacgagaacguggaagagguaauggaacuacugcucgaggaggaauccgcccugcuugaggcuguucagcccuuuuaucaacaggugguccuguacgaauugcucaaaggggagaccuauguggccaaggcaaaagugagcgcuuucaagcaauaccagaaggauauggccucgcugaaaaauuuacuggacaagacguuuggagaaaaagucuaucguucuuacuucauauccgauaagaacucacagcgcgaguaccagaaaagucacaagguugaggugcuaugcaagcucgaccaguucaauaaagaagcgaaguuugccgagacuuucuauaaagaccugaagaaacuuuuggaagauaagagcaagaccuccaucgguacaacugagaaagacgagaugcugagaauuaucaaggcaauugauucuaaccaguuucuccagaaacaaaagggcauccagaaugcugccauaccucaucagaacagccuguacgaagcugagaaaauucuuaggaaucagcaagcccacuauccauucaucaccacagaauggauugagaagguaaagcagauccuggcauuucggauccccuacuauauugggccuuuggugaaagacaccacgcagucaccauucaguugggucgaacgaaagggagaugcccccauaacuccuuggaacuuugacgagcagaucgauaaagcugcguccgcagaggccuucauuagccgcaugagaaagacauguaccuaccucaaaggccaagaagugcugccaaagucuucauuaacuuaugagagguuugaaguucugaaugagcuaaacgguauccagcuccggacaaccggggcugaaagugacuuccgccauagacugagcuacgagaugaaaugcuggauaauugauaauguguuuaagcaguacaagacggucuccaccaaaaggcuuuugcaggagcugaagaaaucuccguaugccgacgaacucuacgaugagcacacaggagaaaucaaggagguguucggcacucaaaaagaaaacgcauuugccaccucgcugagcggcuauaucuccaugaagucaauuuuaggggcuguaguugacgacaaucccgccaugacagaggagcugaucuacuggauugcaguguucgaagaucgugagauacuucacuugaagauccaggaaaaauauccuaguauuacugacguccagcggcaaaagcucgcgcuggugaaacuaccaggauggggucgauucucuagacugcucaucgauggccugccccuugacgagcaggggcagagcgucuuggaucauauggagcaguacuccucaguguuuauggaaguucugaagaacaaaggauucggcuuagagaagaagauccagaaaaugaaucaacaccagguggacgguaccaagaaaauuagguaugaagauauagaggaacucgcugggagcccugcccugaagcgcggcaucuggcggucuguaaaaauugucgaggagcuuguguccaucuuuggagaaccagcaaacauuguucuggagguggccagagaagacggcgagaagaagaggacaaaaagucgcaaggaucagugggaagaguugaccaaaacuacgcucaagaacgaccccgaucugaaaucuuucaucggggagauaaagagccaaggagaccagcgauuuaaugaacagcgguucuggcuauacgucacacagcaagguaaaugucuguacaccggcaaggcucucgauauccagaaccuguccauguaugagguggaccauauucuuccgcagaauuuuguaaaggacgauucauuggacaaccuggccuuagugaugccugaagcaaaucaacguaaaaaccagguugggcagaauaagaugccccucgagaucauugaagcuaaccagcaauacgccaugagaacucugugggagaggcuucacgagcugaaacuaaucaguagcggaaagcucggccgccugaaaaagccaucguucgaugaagucgacaaggauaaauuuauagcgcggcaguugguggagaccagacagauuaucaagcaugugagggaccuguuagaugaacgauucuccaaaucugacauucaccucgucaaggccgguaucguuagcaaauuucgccgguucucagagauaccuaagaucagagauuauaauaacaagcaccaugcuauggacgcacuguuugccgcugcccuuauucagaguauccuggggaaauacggcaagaauuucuuggcauucgaucucuccaaaaaggacaggcaaaaacaguggcguucugugaagggaagcaacaaggaguuuuuccuguuuaaaaauuucggcaaccuacgccugcagucccccgugacaggggaagagguaucaggagucgaauauaugaagcacguguacuuugagcuuccauggcagaccacuaaaaugacacaaacgggugauggcauguucuauaaggaaagcauuuuuagucccaaaguuaagcaggcgaaguacgugucuccuaaaaccgagaaguucguccaugacgaggugaaaaaucacuccaucugccucguugaauuuacuuucaugaagaaagagaaggaagugcaggagacaaaauuuauagaccugaagguaauugaacaccaucaguucuugaaggagccagagagccaacuggccaaauucuuagcugaaaaggagaccaacucgccgaucauccacgcccggauuaucagaacaauucccaaauaccagaagauauggaucgaacauuuuccuuauuacuucauuucaacuagggagcuccacaacgcacgacaguuugaaaucucuuaugagcugauggagaaagucaagcaacuuagugaacgguccagcguggaggaacugaagauuguguucggguugcucaucgaucagaugaaugacaacuacccaauauauaccaaaucuagcauccaggaucgcguccagaaguuuguugacacgcaacuguacgauuucaaauccuuugagauuggauucgaggaacuaaagaaagcuguggccgcaaaugcccagagaucagacaccuuuggcaguaggaucagcaagaagcccaaaccugaggaaguagcuauugguuaugagucuaucacagggcugaaguaccggaaaccacgauccguggucggcacuaagagauga

SEQ ID NO: 2948 - RNA, 4002 nt, Artificial Sequence
  Cas9 variant
augagccagaacaucguggacuacugcauuggccuggaucucgggaccggauccgucgguugggccguuguggacaugaaucacagacuuaugaagaggaacggcaaacaucugugggggucucgguuguucucaaaugcugagacagcagccaaccgccgagcgagucguagcauaagaaggcgguauaauaagcgcagagaaaggauccgguuacugcgcgcuauucuacaagauaugguacucgagaacgaccccacuuucuucauccgacuggaacacacguccuuucuugaugaggaagacaaagccaauuaccugggagcagauuauaaggacaacuacaauuuguucauugaugaggacuuuaacgauuauaccuacuaucauaaauacccuacaaucuaccaccucagaaaggcccugugugagucuacugaaaaggcugacccaaggcugauauaucucgcauuacaucacaucgugaaauaccggggcaauuuccuguaugagggucagaaguuuaacauggaugccucgaauauugaagaccgucuuucagacgucuucacccaguuugcugauuucaacaauaucccguacgaggacgaugagaaaaagaacuuggaaauucuggagauccuuaaaaagccccucagcaagaaagccaagguggacgaaguuauggcgcugauagcaccugagaaagauuuuaagagugccuauaaagaacuugugacagggauugcuggaaacaagaugaaugucaccaaaaugauccugugcgagccaauuaagcagggcgacuccgagaucaaguugaaauucucugauagcaacuacgacgaucaauuuuccgaaguggagaaugaccucggcgaauauguagaguucaucgauucacugcacaacauuuacaguuggguugaauuacagacuauaaugggggccacacauaccuacaaugcaagcaucucugaggcuauggugucccgcuauaacaagcaccaugaggaccugcagcuccuuaaaaaguguauuaaagacaauguccccaagaaguacuucgauauguuuagaaacgacucagaaaaacugaagggauauuacaauuauaucaaccacccuagcaaagccccaguggaugaguucuacaaguaugugaaaaagugcauagaaaaggucgacacgcccgaggcgaaacagauuuugcacgauaucgaacuagagaauuuucugcucaagcaaaacaguaggacuaaugguucuguuccuuaccagaugcagcuggacgagaugaucaaaauuaucgauaaccaggccaaguacuauccagugcuuaaagaaaagcgggagcaacuguuguccauucucaccuucaagauaccguacuauuuuggcccccugaaugaaacaagcgagcaugcauggaucaaacgauuagaggggaaggaaaaccagcgcauucugccuuggaacuaccaggacaucguagauguggacgcuacugccgagggauucaucaaaagaaugaggucguauuguaccuacuuuccagaugaagagguccuacccaaaaauucucucauuguguccaaauaugaaguuuacaacgagcugaauaagauacggguggacgauaaacuuuuggaggucgacaucaagaacgacauuuacaaugaacuguucaugaacaauaagacagugaccgagaaaaagcucaaaaacuggcugguaaauaaccaaugcuguaauaagaacgcugaaaucaaaggcuuucagaaggagaaucaguucucaacgagucuuacuccuuggauugauuuuacaaacaucuucggugaaauaaaucagagcaacuuugaccugaucgaggauauuaucuaugacuugaccguuuucgaggauaagaaaauuaugaagcgcagacucaaaaagaaauacgcccugccagacgauaagaucaagcaaauauuaaaacugaaguauaaagacugguccaggcuaucuaagaaacuccuggaugggauuguggcagacaacaaguucggaagcucagucacugugcuugaugucuuggaaaugagucgucugaaucucauggagaucauuaacgaccgggaucugggcuacgcccagaugaucgaagcugcggcauccugccccgaggacggcaaguuuacauauaaagaagugcagcgauuagccgggagcccggcucugaagagaggaauauggcagucucuucaaaucguugaggagauuaccaaagugaugaaguguaggccuaaauacaucuauauugaauuugagcgcucagaagagacgaaggagcggaccgaaaguaaaaucaagaaguuggagaauguauacaaagaccucgaugaacagacaaaggucgaguacaaaacugugcuggaggaacuaaaggguuuugacaacaccaaaaagauaagcuccgauucucuguuccucuauuuuacacagcugggcaagugcauguacucggggaaaaagcuagacauugauagcuuggacaaauaucagaucgaucacaucguuccccaaucccuggugaaggacgauucauucgacaauagagucuuagugguaccaagugagaaccagaggaaacucgaugaccuggugguuccuucugacauucgcgucaagaugaauagcuuuuggaaacuucuguucgaucaugaauugaucucccccaagaaguuuuacucacucauuaaaacugaguauaccgaacgagacgaggaacgguucauaaaccgucagcugguggagacaagacagaucaccaagaaugugacucaaauuaucgaggaucacuacagcacgacaaaagucgccgcaauuagggccaaccuaucucaugaauuucgcguuaagaaucacaucuauaagaaccgggacauaaaugauuaccaccaugcucacgacgccuacaucguggcacugauuggaggcuucaugagagauagguauccaaacaugcaugacuccaaagcgguguacagugaguauaugaagauguuucgaaagaauaagaacgauaaaaagcgcuggaaggacgguuucguaaucaacagcaugaauuaccccuaugaagucgauggggagcucauuuggaacccugacaucauaaaugaaauucggaaauguuucuacuauaaggauugcuacugcaccacuaaacuggaccagaagucuggccagauguuuaaccuuaccguguugccaaaugacgcucacuccccgaaaggaacaaccgaggccguuauccccgugaacaagaauagaaaagaugucaacaaguacggcggguucucaggacugcaauaugugaucguugcaauugaggguaagaaaaagaggggcaaaaagacuaaauuagugaagaagauaagugggguaccucuccaccugaaagccgcuagccuugacgaaaagaucaaauacauugaggaaaaggagaaucugacagaugucaaaaucauuaaggacucgaucccagugaaccagaugauagagauggauggaggcgaauaucuacucacgucccccaucgaguuugugaauggucgucagcuggucuugaacgaaaagcagugugcccugauugcagacaucuacaaugcuauuuauaaacaagauugcgacaacuuagaugacguucucaugauccagcuguacauagagcuuauuaauaagaugaaagcccuguauccugcguaccagucuaucgccgaaaaguucgagagcaugaccgaggauuacguggcuguaucaaaagaagagaaggcagacaucauuaagcagauguugaucauaaugcaucgcgggccacggaacggcaaaauucaauaugccgauuuuaaugugggagacagaaucggcaggaagaacaaaaugagucucgaccuggaacgagucacuuucgugucccagucucccacagggauuuacaccaagaaauauaagcuauga

SEQ ID NO: 2949 - RNA, 4002 nt, Artificial Sequence
  Cas9 variant
augggcaaggaguacuaucuggggcucgacaucggaaccgauagcguggguugggccgucugcgacacaaacuacaaaauucccaaguucaaaggcaaugcuaugugggggauaagacuuuuugaaaaguccaacucugcagaggaaaggcggggauuccgcucaagucgacguagaacucagaggaaacgggagcgccugaaguuguuagaaaugcuguuugaugaggagaucagcaagauugacccugccuucuuuaucaaacuaagagaauccaaucucuaucuggaggauaagucuacgaaaauuccauacuguguuuucucggacgaaaacuauaccgauaaggacuuucacagggauuacccgacaaucuaucaucuucggaaugagcugauaaaaucaaacaagccccacgacgugcgcuugguauaccucgcgcugcaucacaucauuaagaaucgaggccauuuccuguuugauuacagcuauaaaaacgacaagaguggugauuucaugccuaucuacaaugaccucaaaaacuauuuuuacgacaauuaugagauugaauuagauugcuccgacguggaugaguucgcuaacacucugaaggacaaaucuaaggggaaaaccaagaagaaugccgaaaucgcagagcuuuuuggagucagcaaaaaguacgauaaaguguuguauuccgcccugucacuacucaguggcagcucuguuaagcuguucgacauauucgaugacgaagcucuuaaagauguggagaagaaguccgucucauuuagcaguggcuucgacgauaacgcaaaugacuuucaaucuuaccugggggagagauucgaauugcucgagaaacugaaggccguguacgacugggcuguauuagccgauauucuggacggaaaagaauauaucuccgaggcgaagguugcaauuuacgaaaaacacaagagggaucucaagacacuuaaaaaguauaucaaaaucuacaugccagagaagaaagccgagauuuuuaacauaagcucgaaggacaacaauuauguggcuuacucuaagcacaucaaaaccuccaacgguacuggcguccugauuucaacauguacccaggaagaguucugcgccuauuugaagaaaacgcuagggaucuguaaggaugcaaguuacgaagagauguuuaaagaaauagagaauagcacuuucaugcccaaacaggugaccaaagacaacggaguggucccuaugcagguuaaugagaaggaacugguggcuauucucgauaacgccaaggaguaccugccauuucuucugaauaaagacaacgauggcaagacaguauaugacaaaaucaaggcguuguucgaauaccggauccccuauuacauugguccucucaauacucauuccaccaaaucuuggcuggugcguagcaacgagaagaucuauccauggaauauugaggaugucguggacuuugauaagucagccgaaaaauucauagagaacuuaacaaguaagugcaccuaccugccgcaauaugacguuauccccaaacacucccuacucuacaauaaguuuugugugcugaacgaacuuaauaacuugaaaauugacggggagaagaucagcguccagcugaagcaggauaucuacaacgaccucuucaaaaaguauuacaaagugacgaauaagaaacugugcgauuaucuuaagucucgcaacauugcauucgacgaaauaucaggaaucgauaaugacuuuaagaguagccugaaauccuacaaggauuugguagcuuauaaccucacugacgagcagaaagaggaaauuguuaaggccaucacaauuuucggcgaugacaaaaagcugcugaaaaagagacugaagaaugaguuuggcgggugucuaucugaugacgaaaucaaaaagauaugcaaacucaaguacaccggauggucgaaacugagcagggaguuccuuacugaugugacagcugucuauaaggaaaccggugaguugaucaacauuaucugugcccugugggagacgaauuacaaccucaccucccuguuauacucagacgaauuuugcugcgacgauaaggagaauaaaacauucaacgacaagauuaaugaacugaacaguuuuggcaaugauaaaacucuuaaccaaaucguggaggaauuguaugucucuccucucgugaagcggccaauauaccagagccugcuaauuaccaaagagcuggagaagaucaugaagugucccccuaaaaagauuuucguugaaguggcacgaggggccgaggaaaagaagcgcacaguauccagaaggaauaaacuccuggaccuuuauaagucaugcaagaacgauuacccauugcuguuugacgaguuacagaacaauacuaccgaugacgagcucaaaagcgauaagcuguaucuuuacuucacacaguuuggaaaauguauguauaccggcgaaaacaucgagcugggugacuuguucaauaagaaccucuacgauauagaccauaucuacccccaaucuaaaauuaaggacgauucccuggacaaucggguccuagugaagaaaacuacgaacgcuaagaaagauaaugaauauccgcugaguagccagauccgcgagaagaugacaccucacuggaaagcgcuccuggacaaggggcuuauuaacaaaaagaaguacgaaagauugguuaggaauuauccccugucugaugaggaguuaucccaguuuaucucacgucaacucguggaaacccggcagaguacuaaagcagucgccaacauacuggagcagcuuuacccacgaccugacaccgaaauuguguauguaaaggcugcccuggcaagcgaguucagacaccaguacgauaugcuaaaaugcagggaagugaaugaccuccaucacgccaaggaugcuuaucugaacaucguugucggcaaugccuacaacggaaaauucacacauaauaaggcaaacuuuaucaagggcuugcaaaacaaugacaaagcguacaccgugaagcuggauucgauguuaaaacacaacauugacggggcuuggaucgccgauaauaacgagucccucaauauugugaagucuacuaugaacaaaaauaacauacgcuauacacgguacgcauucgagaagaagggaggucuguuuaaagucacgauccuuaagaaaggcaaugggcaggccagcauuaagaaaaacgacaagagaaauucaaucgaaaaguauggaggcuacaaccagguuaguuccaccuauuucucuuguguggagcaugguaaagacaauaacaggaugauuagcauguuuuccgugaaucuguacgauaagaacaaauaugaagagaaucccaucgcuuacuugauagaaaacuacgggcucaucaacccaauuaucaaggucaaaaagguaaaaauucagucaugcaucagcuucgacaauaugcugugucaccuaggcggaaaggauaguggcgggucucaaauauccuaucgccccggagugcagcugguucuugguuacgacaacgagcgauauauucggaaugugauccguugcgccggcggggaucuccacuuacagacuagcaagaacgagaaagacaucgucacagcagaaaagaauauugaguuguuuaaccuguuaauagagaaaaugaagaauaacaucuacggagugcucuauucgaaucugggcgauaaacuuuacuguucaaaggaaaaguucgagaaacuggacauuguugaacagugcaacgugaucaagaauguauugaccauucucaaaaacaaugcuucuaagggugaucugaaaaguaucgggauaaaggccaacggcgcgaucagacuaaauaacaacauuuccgagaucaagaaagucaagagcauuaaacugaucaaucaaucugugacaggacuuuuugaacaggagauagaacuccugaacuuguga

SEQ ID NO: 2950 - RNA, 4002 nt, Artificial Sequence
  Cas9 variant
augagccagaacaucguggacuacugcauuggccuggaucucgggaccggauccgucgguugggccguuguggacaugaaucacagacuuaugaagaggaacggcaaacaucugugggggucucgguuguucucaaaugcugagacagcagccacucgccgaaguagccguuccauaagaaggcgguauaacaagcgcagagaaaggauccgguuacugcgcgcgauucuacaagauaugguacucgagaaagaccccacguuuuucauccgacuggaacacaccucuuuucuugaugaggaagacaaggcuaaauaccugggaacagauuauaaggacaauuacaacuuguucauugaugaggacuuuaaugauuauacuuacuaucauaaguacccuaccaucuaccaccucagaaaagcccugugugagucgacagaaaaggcagacccaaggcugauauaucucgccuuacaucacaucgugaaauaccggggcaacuuccuguaugagggucagaaguuuaauauggaugcuucaaacauugaagacaaacuuagcgacgucuucacccaguuugcagauuucaauaacaucccguacgaggacgaugagaagaagaauuuggaaauucuggagauccuuaaaaagccccucaguaaaaaggccaaaguggacgaaguuauggcucugauauccccugagaaggaauuuaaaucugccuauaaggagcuugugacugggauugcgggaaacaagaugaaugucacaaaaaugauccugugcgagagcauuaagcagggcgauuccgaaaucaaauugaaguucucagacaguaacuacgaugaccaauuuagcgagguggaaaacgaucucggcgaguauguagaguucaucgacucucugcacaauauuuacuccuggguugaauuacagaccauaaugggggcaacgcauacugauaacgccucaaucagcgaggcuauggugagucguuacaauaaacaccaugaagaccugcagcuccuuaagaaguguauuaaagacaacgucccaaagaaauauuucgauauguuucgcaaugacucugagaaggugaaaggauacuauaacuacaucaauagacccaacaaggccccuguggaugaguucuauaaguuugucaaaaagugcauagaaaaaguugacaccccagaagcaaagcagauucugcacgauaucgaguuggagaauuuccuacugaaacaaaacuccaggacaaaugguagcgugcccuaccagaugcagcucgacgaaaugaucaagauuaucgauaaccaggcuaaguauuacccuguacugaaagagaagcgggaacaacuucugucgauuuugacuuuucgaauaccauacuauuucggcccgcucaaugagaccucugagcacgccuggaucaaacgccuggaagggaaggagaaccagagaauuuuacccuggaauuaccaggacacaguggaugucgacgcgaccgccgaaggauuuaucaaaaggaugcgguccuauuguacguacuucccugaugaggaagugcugccaaagaacucacuaaucguuaguaaauaugagguguacaacgagcucaauaagauucgcgucgacgauaagcugcuugaaguggacguaaagaacgacauauauaaugaguuguuuaugaagaacaaaacuguuacagaaaagaaacugaagaauuggcucgugaacaaucaaugcuguagaaaggaugcagagaucaaaggcuuccagaaggaaaaccaguuuagcaccucccugacucccuggauugacuucacaaauaucuuugguaaaauugaucagucuaacuucgaccuuaucgagaagauaaucuacgaucugaccgucuucgaggacaaaaagauuaugaagaggcguuugaaaaagaaauacgcucucccugaugacaagaucaaacaaauucugaaguuaaaguauaaagauuggagccggcugucaaagaaacuacucgacgggaucguggccgauaaucgauuuggaaguuccgucacggugcuggacguucuugaaaugagcagauugaaccugauggagauaauuaaugauaaggaacucggcuacgcucagaugaucgaggaagccucuucaugcccaaaagacggcaaguucaccuaugaggagguggcaaaacuggccgggagucccgcuuuaaagaggggaauuuggcagagccugcagaucguagaagagauaacaaaggucaugaaaugucgcccgaaguacaucuauauugaauuugagcgguccgaggaagcgaaagagagaacugaaucuaagaucaaaaagcuagagaacguguacaaggacuuggaugaacaaaccaaaaaggaguauaaaucgguucucgaggaacugaaggguuucgacaauacaaagaagauuagcuccgauucacuauuucuguacuucacucagcucggcaagugcauguacagugggaaaaagcuggacaucgauucucuugacaaauaucagauagaucauauugugccucagagcuuggucaaggacgauuccuuugacaacagggugcugguauuacccucagagaaccaacgcaaacucgaugaccuggugguuccauucgacauccgagauaagauguaccgguuuuggaaacuucuguucgaccacgaauugaucagcccuaaaaaguuuuauucucucauuaaaaccgaguacacagaacgugaugaggagagauucaucaauaggcagcuggucgaaacccgccagauuacuaagaacgugacgcagauaaucgaggaccauuauuccacaaccaaaguggcagccauucgggcuaaucuaagucacgaauuuagagucaagaaccauaucuacaagaauagggauauuaacgacuaucaccacgcccaugaugcauacaucguugcccugauaggaggcuucaugcgagaccgcuaccccaauaugcacgauagcaaagcuguguauucugaguacaugaagauguuccggaaaaacaagaaugaccagaaaaaguggaaagaugguuuugugaucaacuccaugaauuauccauacgaaguagacgggaagcucauuuggaaccccgaucugaucaaugagauuaagaaauguuucuauuacaaggacugcuauugcacuaccaaacuugaccaaaagucaggccagauguuuaacuugacaguccugccuaaugaugcccauagugcaaaaggaaccacugaggcggugaucccaguuaacaagaacagaaaggacgugaauaaauacggcggguucagcggauuacaauacgucauagcugccauugaagguacaaagaaaaagggcaaaaagcucgugaagguuaggaaacugucggggaucccgcuuuaucugaagcaggcagauaucaaagagcagauugaauacguggagaaggaggaaaaacuauccgacguaaagauaaucaagaacaauauuccccucaaccagcugaucgagauugauggacgucaauauuugcugacgucuccuaccgaaugugucaaugccaugcaguuagugcucaacgaggaacagugcaaacugaucgcugacauauacaaugccaucuauaagcaggauuuugacggccuugauaacaugcugaugauucaauuguaccuccagcugaucgacaaacuaaagacucuguauccaauuuacauggguaucguggagaaauucgagaaacuuacagaagauuuugucagcauaucaaaagaggaaaaggcaaauguuauuaagcagaugcucaucaucaugcacaaagggccccagaacggcaauauuaucuacgacgauuucaacgugggaaagcgcauaggccggcugaaugggagaaccuuuuauuuggacaacauugaguucaucagucaauccccuacaggaauuuacacuaaaaaguauaaacuguga

SEQ ID NO: 2951 - RNA, 4002 nt, Artificial Sequence
  Cas9 variant
auguacaccuauuacuucaaggagagcgaaaugguguaugacgucggccuggauaucgggacaggauccguugguuggguggcccucgacgagaacggcaaacuugcuagagcaaaggggaaaaaucugguaggagugagguuguuugauacugcccagacggcggcugaccggcgcggcuuccgaaccacacguagaagguuaucucggcgcaaguggagacugaggcuacucgaugaacuguuuucagccgagauuaacgaaauagacaguagcuucuuucaacggcuuaaauacuccuauguccaccccaaggaugaggagaauaaggcacauuacuaugguggguaccuguucccuacugaagaggaaaccaaaaaguuucaccgcucuuacccaacaaucuaucauuugcgacaggagcucauggcccagccgaacaaaagauucgacauuagggagaucuaccuggcuauucaccaucuggugaaguaucggggacacuuucucucgucacaggaaaagaucaccauaggcagcacuuacaaucccgaggauuuagcaaacgccaucgaaguuuaugcugacgagaagggccugaguugggaacuuaauaacccugagcaauugacagagauuaucuccggggaagccggauacggucugaauaagucuaugaaagcggaugaggcacuaaaacucuucgaauuugacaacaaucaggauaaaguggccauuaagacccugcuugcuggccugacggggaaccagaucgacuucgccaaauuguuuggaaaggacauaagcgauaaagacgaggcaaagcucuggaagcugaaauuagaugacgaagcucuggaggagaagucccagacuauucucucacaacuuaccgaugaagagaucgaacuguuccacgccgucgugcaggcguaugacggcuucguauugauuggucuacugaauggggccgauaguguuagcgcagcuauggugcagcucuacgaccagcaucgugaggaucgcaaacugcuuaagucucuggcccaaaaagcuggauugaagcacaagagauuuuccgaaaucuacgagcagcucgcccuggcaacagacgaggccacuaucaaaaacggcauuucaaccgcuagggaauuagucgaggaaagcaaucugaguaaggaggugaaagaggauacacuacggcgacucgacgaaaacgaguuccugccaaagcagcgcaccaaagcgaacucugugauaccccaucaacuucacuuggcagaacugcagaagauccuccagaaucagggccaauauuacccuuuucugcuugacacguucgagaaggaagaugggcaggacaacaaaauugaggagcuguugagauuuaggaucccauauuacgucggaccccucguuacuaagaaagauguggaacacgccgguggcgacgcugauaaucauuggguagagcggaacgaaggguucgagaagucccgcgugacaccuuggaauuuugacaaagucuucaacagagauaaggccgcaagggacuuuauagaacgucugaccggaaaugauacuuauuuaauuggcgagaagacacugccacagaacagccuacgguaccaacucuucaccgugcugaaugagcuuaacaauguucgagugaacgguaaaaaguuugacucgaaaacgaaggccgauuugaucaaugaccuguucaaagcuagaaagaccgucucucucuccgcccugaaagauuauuuaaaggcacaggggaagggcgacgugacaaucacuggacuggcggacgaaucaaaauuuaacaguagccuuuccucuuacaaugauuugaagaaaaccuucgacgcugaguaccucgaaaacgaggauaaccaggaaacacuggagaagauuaucgagauucagacuguauucgaagacagcaaaauagccucaagggagcuaaguaagcugccgcucgaugacgaucagguuaagaaacugucccaaacccacuauacaggcugggggcgccuuagcgaaaaguugcuggacucuaaaaucauugaugagcggggacagaaggugucaaucuuagacaaacucaagaguaccagccagaauuuuauguccaucauuaacaaugauaaguacgguguccaggcauggauaacugagcaaaacacggggucuucgaaacugacauucgacgaaaaggugaaugagcuuaccacuagccccgccaacaaaagaggcaucaagcaguccuuugcuguccugaaugauauuaaaaaggccaugaaggaggaaccuaggcgcguguauuuggaguucgcacgagaagaccagaccucaguucggagugugccacguuacaaccaacucaaagagaaguaucagucuaaaagccuguccgaagaggcuaagguacuaaagaagacacuggacggaaauaaaaacaagaugucagaugacagauacuuucucuauuuccagcagcaaggcaaggauauguacaccgguaggcccaucaauuuugaacgccugagccaggacuacgauauugaccauaucauaccucaggccuucacuaaagaugacucucuugauaaccgggucuugguguccagaccagagaaugcgaggaagagugacagcuuugccuauacagaugaaguucagaaacaagacgggucucuguggacguccuuacucaagucaggcuucaucaaccgcaaaaaguacgagcgacugaccaaggcuggaaaauaucuugacggccagaagacuggguuuauugcacggcagcugguggagacaagacagaucauuaaaaaugucgccagucuaaucgaaggagaguacgaaaacagcaaggcuguggccauaaggucggagauuaccgcagauaugcgucuccugguagguaucaaaaagcaccgcgaaauuaacuccuuccaucacgcguuugacgccuugcugaucacagcugccggccaauauaugcagaaucgguaccccgauagagacucuacuaacguguauaaugaguucgauagguacaccaacgacuacuuaaagaaucuccgacagcugagcucacgggaugagguucgcagacuuaaaaguuucggguuugucgugggaacgaugaggaagggcaacgaagacugguccgaggaaaauaccucuuaucugcggaaagugaugauguucaagaacauauugacaacuaaaaagaccgagaaggaucgagguccgcucaauaaagagacaaucuuuagcccuaaguccgggaaaaagcugauuccccuaaacucaaaaagaagcgacacugcacuguacggcggauauaguaaugucuacucugcuuauaugacccuuguucgcgccaacggcaagaaucuccugaucaagauuccaaucuccauagcaaaccaaauugaaguggggaauuugaaaaucaacgauuacaucgugaacaauccugccauuaagaaauucgagaagauccugauuagcaaauuaccccucggacagcugguaaacgaagacggcaaucuuauauaucuggcuucgaacgaguacaggcacaaugcgaagcaguuguggcucucaacgacagaugccgacaaaaucgcaucuauuagugaaaacuccagcgacgaggagcugcuagaggcuuacgauauccugaccucugaaaaugucaagaaccguuuuccauucuuuaagaaagacauugauaaacuuagccaggugcgggacgaguuccucgauuccgacaaaagaaucgccguuauacaaacuauccugagggguuugcagauugaugccgcuuaucaggcacccgugaagaucauuaguaaaaaggucucagacuggcauaaguuacagcaaagcgggggaaucaaacugucugauaauuccgaaaugauauaccagucagccacaggcauuuuugaaacccgcgugaagaucagugaccuccuguga

SEQ ID NO: 2952 - RNA, 4005 nt, Artificial Sequence
  Cas9 variant
augaagaaccccuacaccaucggccuggacauugggacaaauagcgugggaugggccguccucacuaaccaguaugaucuuguuaaaagaaagaugaaaguggcugguaauuccgacaagaaacaaauaaagaagaacuucuggggcguaaggcuguuugaugacgggcagacggcaguggaucggcgcaugaaucgaaccgcccguagaaggaucgagcggcgcagaaacaggauuucuuacuugcaggaaaucuucgcggucgagauggcuaauauugacgccaacuuuuucugccgguuaaaugauucauuuuauguggacagugaaaaacgcaacagccgacacccuuucuuugcaacaaucgaggaagagguugccuaccauaagaauuauagaacuauauaccaccugagggaggagcuagugaacuccucugagaaagcugaucuccggcuggucuaucuugcacuggcccauaucauuaaguaccguggaaauuucuugaucgaaggcgcucucgacaccaaaaacacaucgguggaugguguauacgagcaguuuauucaaaccuauaaucagguuuucaugucaaacaucgaggaagggacucuggccaagguggaggaaaacauagaggucgcgaauauucuggcaggaaaguuuacacgcagagaaaaauucgagaggauccuccaguuauacccaggcgaaaagagcaccggcauguuugcccaguucauuagucugaucgugggguccaaaggaaacuuccaaaagguguuugaccuuaucgaaaagacggauauugagugugcuaaggacucuuaugaagaggacuuggaagcccugcuagcaauaaucggugaugaguacgcugaacucuucgucgccgcgaaaaauacuuauaacgccguugugcugagcuccauuaucaccguaacagcaacugaaaccaaugcuaaacuuucagccaguaugauagagcgguuugacgcucacgaaaaggaucugggcgaguugaaagccuucauuaagcuccaucugccgaaacaguaccaggaaaucuuuaacaaugcagccaucgacggguaugcuggauacauugauggcaagacaaaacagguggacuucuacaaguauuuaaagaccauccuggagaacauugagggugcggauuacuuuauagcaaaaaucgaagaggaaaauuuccuccgaaagcaacgcacguuugacaacggggccauuccccaccagcuucaccuggaggaguuggaagcuaucauccaucagcaagccaaauauuacccuuuccuaagagaggauuaugaaaagauuaaaagccuggucacuuuuaggauaccauacuucgugggaccccucgcaaagggccagucugaguuugccuggcugacacggaaggcugacggcgaaauccgcccuuggaauauugaggagaaaguugauuucgggaaguccgccguggacuucaucgagaaaaugaccaacaaggacacuuaucuuccaaaagagaauguccugcccaagcacucauugugcuaccagaaguacaugguguauaacgaacucacaaaaguaagauacauugaugaccagggaaagaccaauuauuuuagcggucaagagaaacagcagaucuucaacgaucuguuuaagcagaaaaggaagguuaaaaagaaggacuuagaacuguuccuacguaacauaaaucauaucgagaguccuacgauugagggccucgaagauucuuuuaacgcauccuacgcgaccuaucacgaccugcuuaaaguggggaugaagcaagagaucuuggauaauccacugaacacagaaaugcucgaggacauugucaaaauccugacuguguucgaagauaagccgaugauaaaagagcagcuucagcaguuuagcgacguccuggauggaggcguguugaagaagcucgagcggcgacacuacaccgguugggggagacugucggcuaaauuacugguuggcauuagggaaaagcaaucucaucuaacaauccucgacuaucugaugaaugaugacggacuuaaccgcaauuugaugcagcugauuaacgacuccaaucucucauucaaaaguaucauagagaaggaacaggugagcacuaccgauaaagaccugcaguccaucguagccgauuuagcaggcucucccgccauuaagaaggggauccugcaaagccuuaaaauugucgacgaguuggugucaaucaugggauacccuccacagacaauaguuguggagauggcucgggaaaaccagaccacugguaagggcaaaaauaacaguaagcccagauacaaaucccucgagaaggccauuaaggaauuugggagcaaaauccugaaggagcacccuacggauaaucaagaacugaaaaacaauaggcuauaucucuacuaucugcagaacggaaaggacauguacacaggccaggagcuugauauccauaacuugucuaauuaugacauugaucacaucgucccacagucauucauuaccgacaacaguauagauaaucugguguuaacuagcuccgcagguaaccgcgagaaagggggcgacguacccccgcucgaaaucgugcgaaagcggaaagucuuuugggagaagcuguaccaaggaaaucuuaugucuaagcguaaauucgauuaucugaccaaggcugaaagaggcggguugacagacgccgacaaagcgagguuuauucaucgccagcucguugagacccggcagaucacuaagaacguggccaauauucugcaccagagauucaacaaugaaacagauaaccacggaaauacgauggagcaagugaggaucgucacccuaaaaucggcucugguuagccaguuccgaaagcaguuucagcucuacaaggugcgcgaggugaacgacuaccaucacgcacaugaugccuaucugaaugguguagucgcuaacacucuuuugaaaguguacccucaacuggaacccgaguucguuuauggcgaauaccaccaguuugacugguucaaggccaauaaagcaacagcgaagaaacaguuuuauaccaacauaauguuauucuuugggcaaaaggagcggaucauugaugaaaacggagagauccucugggacaagaaauaccuggagacaauuaagaaagugcuugauuauagacagaugaauaucgucaagaaaacugaaauacagaagggcgaguucuccaaggccaccauuaaaccaaaggguaacucaaguaaacugaucccuaggaaggaaaauugggaccccaugaaauacgggggccuagauucuccaaacauggcuuacgccgugaucauugagcacgcaaagggaaagaaaaagcucauauuugagaaaaagaucauucguaucacgauuauggaacgcaaaauguucgagaaggacgaagaggcuuuucuggaagagaaaggcuaucggcaucccaagguuuugaccaagcugccuaaauacacauuauaugagugugaaaaggggagaaggcgaaugcucgccagcgcaaaugaggcccagaaaggaaaccaacuggugcuuuccaaucaccugguaucauugcucuaccaugcuaagaacugcgaagcgagcgauggcaaaucucugaaguauaucgaggcccaccgggaaacuuucuccgagcuacuggcacaggucagugaguucgcuacccgcuacacacuugccgacgccaaucucagcaagauaaacaaucuguuugaacagaacaaagagggugacauccaggcuauugcacaaucuuucguggauuugauggccuuuaaugcgaugggggcuccagccuccuucaaguuuuucgaagcaacuaucgacagaaaaagguauaccaaccugaaggaguuacucucaaguacgauuaucuaccagagcauaacaggacuguacgaaucgcggaaacgacuugaugacuga

SEQ ID NO: 2953 - RNA, 4005 nt, Artificial Sequence
  Cas9 variant
augaagaaacccuacaccaucggccuggacauugggacaaacagcgugggaugggccgcucucacugaucaguaugaccuugucaagagaaaaaugaagguugcagguaauuccgagaaaaagcaaauaaagaaaaaccuguggggcgugagguugguagaugaagggaagacggccgcgcaccggcgcgugaaucgaaccacacguagaaggaucgagcggcgcagaaacaggauuucuuacuuacaggaaaucuucacugcugagauguuugaagucgacgccaauuucuuuuaucggcuggaggauucauucuacauugagagugaaaaacgccagagccgacauccuuucuucgcaaccaucgaggaagagguggccuaucacgagaacuacagaacaauauaucaucuaagggaaaagcucguuaauuccucugacaaagcugaucugcggcuuguguaccuggcauuggcccacaucauuaaguaccguggaaacuuucucaucgagggcaagcuggacaccaaaaauacuucggucgaugaaguguucaagcaguuuauuaaaacauauaaccaaguauucgcuucagacaucgaggaagguagccugacccgcauagaggagaauaacgaaguugccaagauuuuuagugagaaacucacgaagagagaaaaauuagauaagauccugaaucuuuacccaaacgagaaguccacugacuuguucgcgcaguuuauuucucugaucaucgggagcaaaggaaauuucaagaaauucuuuaaccuaaccgaaaagacagauauugagugcgcaaaagacuccuaugaggaagaccucgaggugcugcuugccagggucggcgaugaauacgcugagauauucguggccgcaaagaacgcuuauaaugccgugguccugucaaguaucauuacuguuagcaacaccgaaacaaaggcgaaauugucugccuccaugaucgagcgguuugacaagcaugauaaagaccucaagcgaaugaaagcauucuuuaaggugcgccugccggagaauuucaacgaaguauuuaaugauguggagaaggacggcuacgcuggguauauagaaggaaaaaccaagcaggaggccuucuacaaauacaugaagaaaauguuagagcacgucgaaggugcugauuauuuuauuaaccagaucgaggaagagaauuuccugagaaagcaaaggacguuugacaacggcgccaucccccaccagcuccaucuugaggaacuggaggcaauuuugcaccagcaggccaaguacuauccuuuccuaaaaguggauuacgaaaagaucaaaucacugguuacuuuucggauuccauauuucguggggccccucgcuaauggacaaagcgaguucaguuggcugacacgcaaggcggacggcgaaauaagaccuuggaacaucgaggaaaaagucgauuuugguaagucugcaauugacuucaucgagaaaaugaccaauaaggacacuuaccuuccaaaggagaacgugcugcccaaacauuccauguguuaucagaaguacaugguauacaaugaauugacaaaaaucagguauaccgaugaccaggggaagacgcacuacuuuagcggacaagagaaacagcagauuuucaacgaucucuuuaagcagaagcguaaaguuaagaaaaaggaccuggaauuauuccuguauaauaugaaccacguggagucgccuaccgucgaaggcguggaggaugccuuuaacucuuccuucacaacuuaccaugaccuacaaaaagucggcgugccacaggagauacucgaugacccgcugaauaccgaaaugcuugaggaaaucauuaagaucuugacaguuuuugaggauaagcggaugauuaacgagcgacugcaggaguucucaaaugugcucgacgaagcuguacugaaaaagcucgaaagaaggcacuauacuggguggggacgccugagugccaaauugcucaucgguauacgggauaaggagagccaucugaccaucuuagacuaccugaugaacgaugacaaacacaauagaaaccuaaugcagcucauuaaugacuccaaccugucuuuuaagagcaucauugaaaaggagcaagucucaacagcagauaaagacauccagaguauaguggccgaucuugcuggcucccccgccauuaagaaagggaucuugcagagccugaagauuguugacgagcucgugggaaucaugggcuauccuccacagaccauagucguggaaauggcaagggagaaucaaacuacggguaaagggaagaacaauucuaaaccccgcuucacaucacuggaaaaggcgaucaaggaguuaggcagucagauucugaaagaacauccuaccgauaaccagggacuuaagaaugaccgauuguaccucuacuaucugcagaacggcaaagauauguacacugggcaagagcuagacauccacaaucugagcaacuaugauauugaccacguagugccacaguccuuuaucaccgauaacucuauagacaaucggguucucgcuucgagcgccgcaaaccgugagaagggagauaauguccccucccuggaaguggugagaaaaaggaaggucuacugggagaaacuuuaucaggccaaauugaugucaaagcgcaaauucgacuaccugacaaaggcugaacgggguggcuuaaccgaggccgacaaagcaagauucauucauaggcaacucguugaaacucgacagaucacaaagaacguggcuaauauccugcaccagcgcuuuaacugcaagaaagaugagagugggaaugugauugagcagguacggaucgucacgcuuaaggccgcgcuggugucucaauucagaaaacaguuucaguuguauaagguuagggaagugaacgacuaccaucacgcccacgaugcuuaccucaauugugucguggcaaacacccugcuaaaaguuuauccgcagcuggagccugaguucguguacggagacuaucaucaauuugauugguucaaggccaauaaggcuacugccaaaaagcaguuuuacacaaacauuaugcuuuucuuugcaaagaaggaccguauaaucgaugaaaauggcgagauucugugggacaaaaaguaucuugauaccaucaagaaaguauugaacuaccgccagaugaauauugucaagaaaacagaaauccagaagggugaguucagcaacgcgacugccaaccccaaaggcaauuccucaaagcugauaccacggaaagcugacugggauccuaucaaguaugggggauuugacggcagcaacauggccuacgcaauugugaucgaacacgagaagaggaaaaagaaaaccgugauuaagaaagaauuaauccaaauaaauauuauggagagaacggcuuucgagaaggaccagaaggaguuccucgaagggaaaggauaccgaaaccccaaggucaucaccaaaaucccaaaguauacacuguacgaaugcgagaauggucggcgcagaaugcuuggcucugccaacgaagcacagaaagggaaucaaaugguucugcccaaccaucuaaugacucuccuguaucacgccaagaauugugaggcuuccgauggaaagaguuuggcguacauugagagccauagggaaauguuugccgagcuguuagacucuauauccgaauuugcaucacgguauacccucgcugaugccaaccuggagaaaaucaauacaauuuuugaacagaacaagaguggcgacgugaaaguaaucgcccagagcuucgugaaucuucuggaguuuaacgcuaugggugccccugcaucguucaaguacuuugagacuaauauugaacgaaaaagauauaacaauuugaaggagcuccugaacgcgaccaucauauaccaguccaucacggggcuauacgaagcucgcaagaggcuggaugacuga

SEQ ID NO: 2954 - RNA, 4005 nt, Artificial Sequence
  Cas9 variant
augaagaaccccuacaccaucggccuggacauugggacaaauagcgugggaugggccguccucacugaucaguaugaccuuguuaaaagaaagaugaaaguggcugguaacuccgauaagaaacaaauaaagaagaauuucuggggcguaaggcuguuugacgaugggcagacggcaguggaccggcgcaugaaccgaaccgcccguagaaggaucgagcggcgcagaaauaggauuucuuacuugcaggaaaucuucgcggucgagauggcuaacauugaugccaauuucuucugccgguuaaacgacucauuuuauguggauagugaaaaacgcaauagccgacacccuuucuuugcaacaaucgaggaagagguugccuaccauaagaacuauagaacuauauaccaccugagggaggagcuagucaauuccucugagaaagcugaccuccggcugguguaucuugcacuggcccauaucauuaaguaccguggaaacuucuugaucgaaggcgcucucgauaccaaaaauacaucgguggacgagguauacaagcaguuuauucaaaccuauaaccagguuuucaugucaaauaucgaggaaggugcccuggcgaagguggaggaaaacacugaggucgcaagcauacuggccgggaaauuuacacgcagagaaaaguucgagaggauucuccgguuauacccaggagagaaaaguaccggcauguuugcucaguucaucucccugauugugggcaacaaggggaauuuccagaaaguguuuaaccuugucgaaaagacggauaucgagugugccaaagacucuuaugaagaggacuuggaagcacugcuagcuaucauuggagaugaguacgccgaacucuucguugcggccaagaauacuuauaacgcagugguacugagcuccauaaucaccgugacagcuacugaaaccaaugccaaacuuucagcuaguaugauugagcgauuugacgcccacgaaaaagagcugggugaauugaaggcauucaucaaacuccaucugccgaagcaauaccaggagauauuuaacaaugccgagauugauggcuaugcuggguacaucgacggaaaaacaaagcaggucgauuucuacaaguauuuaaaaaccacgcuggaaaacguggagggcgcggacuacuuuaucacuaagauugaagaggagaauuuccuccgcaaacagagaacauuugauaacgguguuaucccccaccaacuucaccuggaagaguuggaagcaauucuacaucagcaggccaaguauuacccuuuccugagggagggguaugacaaaauaaagagccucgugaccuuucggaucccauacuucgucggaccccuggcuaauggccaaucugaauuugccuggcuuacucgcaaggaugacggcgagauuagaccuuggaacaucgaggaaaaaguggauuucgggaaguccgcaguagacuucaucgagaaaaugacaaauaaggacaccuaucugccaaaagaaaacguuuugcccaagcacucacucugcuaccagaaguacaugguguauaaugagcugacgaaaauuagguacauagaugaccagggaaagaccaacuauuuuagcggucgugaaaaacagcaaaucuucaacgauuuauuuaagcagaaacggaaggucaaaaagaaggaccuggagcuauuccuccgaaauauuaaccauaucgagaguccuacaauugaaggccuggaggauucuuuuaaugccuccuacgcuacuuaucacgaccuuuugaaaguggggcugaagcaggaaauccucgauaacccacugaauaccgagauacuugaagacaucgucaaaauucugacaguguucgaggauaagagaaugaucaaagagcaguuggaacaauuuagcgacguucucgauggagugguacugaagaaguuagagaggcgccacuacacuggcuggggucggcugucggccaaacuacucgucgggauuagagacaagcagucucaucugaccauccuugauuauuugaugaacgacgacggccugaauaggaaccucaugcagcugauaaaugauuccaacuuaucauucaaaaguauuaucgaaaaggaacaggugagcacaaccgacaaagaucugcaauccauuguugcagaccuugcgggaucuccggcuaucaagaagggcauauugcagagccucaaaaucguggaugagcuggucucaauuaugggguaucccccucagacuaucgugguagaaauggcccgcgagaaucagacgacaggaaaggguaaaaacaauaguaagccacgauacaaaucccuagaaaaggcaauuaaggacuuuggcagccaaauccugaaagagcaccccaccgauaaccaggaacucaagaauaaccggcuguaccuuuacuauuugcagaacgggaaagacauauacacuggacaagagcuggauauucauaauuuaucuaacuaugacaucgaucacaucgugccucagucauucauuaccgacaauaguaucgauaaccucguucugacaagcuccgccggcaaucgugagaaggguggggacgucccaccccuugaaauugugagaaaaaggaagguguuuugggagaaacuguaccagggcaacuugaugucuaagcgcaaguucgacuaucucaccaaagcugaacggggaggccugacugaggccgauaaggcaagauuuauacauaggcagcuagucgaaacacgacaaaucacgaaaaauguugcuaacauucugcaccagcgcuucaauaaggagaccgacaaccacgggaauacuauggaacaggugcggaucgugacacucaaaucggcccugguaagccaguucagaaagcaauuucagcuuuacaaggucagggaagugaacgauuaccaucacgcgcaugacgccuauuugaauggaguuguggcuaacacccuguuaaaagucuacccgcagcucgagccugaauuuguguauggugaguaccaccaguuugauugguucaaggcaaauaaagccacagcuaagaaacaauuuuauacuaacauuaugcuguucuuugcccagaaggaacguaucauagacgagaacggcgagauccuuugggauaagaaauaccuggaaaccauuaagaaaguucuagacuaucgccagaucaauauugugaagaaaacggagauccaaaagggggaguucuccaaggcaaccauaaaacccaagggaaacucaaguaaacucauuccacggaaggagaauugggauccuguaaaauacggcggucuggacucucccaacauggcguacgccgucaucaucgagcacgcuaaggggaagaaaaagauugugauagaaaagaaguugauccagauuaauaucauggagagaaaaauguuugaaaaggaugaggaagccuuccuggaggagaaaggcuaucaucagccaaagguguuaacaaagcuccccaaauacacucuguaugaaugugagaagggaaggcgacggaugcuuagcuccgcaaacgaagcucagaaaggcaaucaacuggucuugucaaaccaccucguuagccugcuauaccaugccaagaauugcgaggcaucugacgggaaaucccugaaguauauugaagcccaccgcgagaccuuuagugagcuucucgcucaggugagcgaguucgcgacaaaguacacucuggccgacgcaaacuugucuaaaaucaauaaccuguucgagcagaauaaggaaggagauauaaaagcuaucgcccaguccuuuguagacuuaauggccuucaacgcuaugggcgccccugcaucauuuaaguucuuugaggcgaccauugauagaaaaagguauacgaaucucaaggaacugcuuaguagcacaaucauuuaccaaucgaucaccggucuguacgagucccggaagcgauuggacgauuga

SEQ ID NO: 2955 - RNA, 4005 nt, Artificial Sequence
  Cas9 variant
augggcagaaagcccuacauccugagccucgacauugggaccggauccguggguuaugccugcauggauaaaggcuucaacguccuuaaguaccacgacaaagaugcucuggggguuuauuuguuugacggagcauuaacagcccaggagaggcggcaauuccgcacuucucgacguagaaagaauaggcggauaaaacgccugggccuacuccaggaacugcuugcgccucuggugcagaacccaaauuuuuaccaguuccaaagacaguuugcuuggaagaacgauaauauggacuucaagaacaaaucauugagugagguacucagcuuucuggguuaugaauccaagaaauacccgacgaucuaucaucugcaggaggcccucuuacugaaggaugaaaaauucgaccccgagcuuauuuacauggcauuguaccaccuggugaaguauagggggcauuuucuauucgaucaccucaagaucgagaaucugaccaacaaugacaacaugcaugauuuugucgaacuuauugagacauacgaaaaucugaacaauaucaaauugaaccucgacuaugagaagacuaaagugauauacgagauccugaaggauaaugaaaugaccaaaaacgaccgggccaagcgcguuaaaaacaugcagaagaaguuagagcaauucucuauuaugcugcucggacuuaaauuuaaugaaggcaagcuguucaaccacgcugacaaugcagaggaauugaaaggcgccaaccagucgcacacauucgcugauaauuaugaggagaaccuaaccccuuuucugacuguggaacagucagaguucaucgaacgagccaauaagauuuaccucagccugacacuucaggacauccugaaagggaagaagaguauggcgauguccaaagucgcagccuaugauaaguuuagaaacgaguugaaacaagugaaggacauaguauacaaagcugauucuaccaggacgcaguucaagaagauuuuuguuagcuccaaaaagucacucaaacaguacgacgccacuccaaaugaucaaaccuucaguagccuguguuuauuugaccaguaucugauccggcccaagaaacaguacucucuacucauuaaggaacugaagaaaaucaucccucaggauuccgagcuuuauuucgaggcagaaaacgacacauugcugaaggugcucaauacuaccgauaacgcuucaauuccaaugcaaauaaaucuguacgaggccgaaacaauccuucguaaccagcagaaauaucaugcggagauuaccgacgaaaugaucgagaagguccugagcuugauacaguuucgcauucccuacuaugugggaccucucgugaaugaccacacggccaguaaauucgguuggauggagagaaagucuaacgaauccaucaaaccauggaacuuugaugaggucguugacaggagcaagucggcaacucaauucauccggcgaaugacaaauaagugcucuuaccugauuaacgaagauguguuaccgaaaaauucccugcuauaccaggagauggagguacucaacgaacugaaugcuacccagauccgccuucagacugaccccaagaacagaaaauauaggaugaugccucaaauuaaguuguuugccguggagcauauauucaaaaaguacaagacagucucacacaguaaauuccuggaaaucaugcucaauagcaaccaccgggagaauuuuaugaaccauggcgaaaagcuguccauuuucgggacccaggaugacaaaaaguuugcuucuaaauuaagcucauaucaggauaugacgaagaucuucggagacaucgagggcaagcgcgcccagauugaggaaauaauccaauggauuaccaucuuugaggauaaaaagauucuggugcagaaacuuaaggaauguuacccagaguugacaaguaaacagaucaaucaacucaagaagcugaacuauuccgguugggggagacuaagcgaaaaacugcucacucacgcauaccagggacauucuauaaucgagcugcuuaggcacucagacgagaauuucauggaaauuuugaccaacgauguuuauggcuuucagaauuucaucaaggaggaaaaccaggugcaaaguaacaaaauucagcaucaggacaucgccaaucugacaacuagccccgcuuuaaagaaaggcauaugguccaccauuaagcucguccgugagcugacaucuaucuuuggggaaccugagaaaauuaucauggaguucgcgaccgaagaucagcaaaagggaaaggagcagaaaucgcggaagcagcuuugggacgacaacaucaaaaagaauaaacuuaagagcguggaugaauacaaguacauaauugacguagcaaacaaauugaauaacgagcagcuccaacaggagaagcuguggcuauaucugucccagaaugguaaaugcauguacucaggccaaaguaucgaucucgacgcccugcuuucuccaaacgcuacuaagcacuaugaaguugaucacauuuuuccccgauccuucaucaaagacgauagcauagacaauaagguguuggucauuaagaaaaugaaccagacgaagggggaucaggugccgcugcaguuuauccaacagccuuacgagagaaucgccuauuggaaaucauuaaauaaggcaggacucauuagcgacucuaaacugcauaagcugaugaagcccgaguucacagccauggauaaagaaggcuucauccagaggcagcuggucgaaacccgccaaauuuccgugcacguucgggacuuucuaaaggaggaguacccaaacacuaaagugauaccuaugaaggcuaaaaugguaagugaguucagaaagaaguuugauauccccaaaauuaggcagaugaaugacgcccaucacgcaaucgacgcguaucucaacggugucguguaccacggggcucagcuggccuacccaaauguugauuuguucgacuuuaacuucaagugggaaaaagugcgcgaaaaguggaaagcacugggcgaguuuaacaccaagcagaaaagccgagaauuauucuuuuucaagaagcucgagaaaauggaggucucucaaggagaacggcugauuuccaagaucaaacuugauaugaaucauuuuaagauaaacuauucacguaaacuggccaauaucccccagcaguucuacaaccagacagcugugaguccuaagaccgccgaguugaaguaugaaagcaauaaaucgaacgagguaguguacaagggccucacuccauaucaaacauacguugucgcaauuaaauccgugaauaagaaagggaaggaaaagauggaguaucagaugaucgaccacuacguguucgauuuuuacaaauuccagaacggaaaugagaaggaacuggcucuauaucuggcccaaagagagaacaaagacgaaguccuugaugcgcagauuguuuacucucucaauaagggugaccuguuguauaucaacaaucauccguguuacuuugugagcaggaaagaggugauaaacgccaagcaguucgagcugacgguagaacagcaauuaucacucuauaaugucaugaacaauaaggagaccaacguggaaaaacugcuuauugaguacgauuuuaucgcugaaaagguuaucaacgaguaucaccauuaccugaauaguaaauugaaggagaaacgcgugcggacuuucuuuuccgaaucuaaccagacacacgaggacuucauuaaggcacucgaugaacuguuuaaagucgugaccgccagcgcuacaagauccgacaagauaggcucaaggaagaauagcaugacucaccgagccuuccuagggaaaggaaaggacguuaaaaucgcauacaccaguauuucuggccugaagacgaccaaacccaagucccuuuuuaagcucgcggagagccgcaacgaacuguga

SEQ ID NO: 2956 - RNA, 4005 nt, Artificial Sequence
  Cas9 variant
augaagaaccccuacaccaucggccuggacauugggacaaauagcgugggaugggccguccucacugaucaguaugaccuuguuaaaagaaagaugaaaguggcugguaacuccgauaagaaacaaauaaagaagaauuucuggggcguaaggcuguuugacgagggggaaacggcagccgaucggcgcaugaaccgaaccgcgcguagaaggaucgagcggcgcagaaauaggauuucuuacuugcaggaaaucuucgcuuuagagauggccaacauugacgcaaacuuuuucugccggcugaaugauucauuuuauguggacagugaaaaacgcaauagccgacacccuuucuuugccacaaucgaggaggaagucgcuuaccauaagaacuauagaacuauauaccaccuaagggaggaacucguuaauuccucugagaaagcagaucugcggcuuguguaucuggccuuggcucauaucauuaaguaccguggaaacuuccucaucgagggcgcccuggacaccaaaaauacaucgguggauggugucuacaagcaguuuauucagaccuauaaccaaguguucaucucaaauauagaagaggggacucuggcgaagauggaagagaacacaaccguagcagacauucucgccggaaaauuuacgcgcaaggaaaaauuagagagaauccugcagcuuuacccaggcgaaaagagcacuggcauguucgcucaguuuauuaguuugaucguuggguccaaaggaaacuuccagaagguguucgaucuggucgagaaaaccgacaucgagugugccaaggacucuuaugaagaggaucuagaagcacuccuggcuauuauaggugacgaguacgccgagcuuuuuguggcggccaagaauacauauaacgcagugguccugagcuccaucauuacuguuaccgauacagaaaccaaugcuaaauugucagccaguaugaucgagagguucgacgcucacgaaaaggaucuccgggagcugaaagccuuuauaaaguuacaucugccgaaacaauacgaagagauuuucagcaacguggcaaucgacggcuaugccggguacaucgauggaaagacgaagcagguagacuuuuacaaauaucucaagacucuucuggagaauauugaaggcgcugauuacuucaucgcgaaaauugaggaagagaacuuuuugcgaaagcagcgcacauucgacaauggugcaauaccccaccagcuacaccuggaggaacucgaggccauccugcaucaacaggcuaaauauuacccauuuuucaaggaagccuaugauaagauuaaaucucuugugaccuuuagaaucccuuacuucgucgggccccuggcaaacggacaguccgacuuugccugguugacuaggaaggcugacggcgagauccggccuuggaauauugaagagaaaguggauuucggcaagucagccguugacuucauagagaaaaugacaaacaaggauaccuaucucccaaaggaaaaugugcugcccaaacacagcuuauacuaccaaaaguauauggucuacaacgagcugacgaaagugcgcuauaucgacgaucaggggaagaccaauuacuuuaguggacaggaaaaacagcaaauuuucaacgacuauuuuaagaaaaagagaaagguaucuaaaaaggaucuagagcaguuccucaggaauaugucccauaucgaaagcccuacaauugagggucuggaggacucguuuaacucuuccuacgcaacuuaucacgaucuuuugaaaguuggcaucaagcaggaagugcuggagaacccacucaauaccgaaaugcuggaggacauagucaaaauccuuacaguguucgaagauaagcguaugauuaaggagcagcugcaacaguuuucagacgucuuggauggggcggugcucaaaaagcuggagcggcgacacuacacuggauggggcagauuaagugcuaaacugcuaguugguaucagggacaagcagagccaucucaccauucuggacuaccuuaugaacgaugacggguugaaucgcaaccugaugcagcucaucaaugauuccaaccugucuuucaaaagcauaauugaaaaggagcaagugucaacaaccgacaaggauuuacagaguaucguagccgaccuggcaggcuccccggccauuaaaaagggaauccuucagagcuugaaaauagucgaugaacucgugucuaucaugggcuaucccccucagacuauuguuguggagauggcucgggagaaucaaacgacagucaaggggaaaaacaauucaagaccaagguacaagagucuggaaaaggccaucaaagaguuuggaagccagauucuaaaggaacaccccaccgacaaccaggagcugcgcaauaaccgacucuaucuguacuaucuucaaaaugguaaagauauguacacuggccaggaauuggacauccauaaccuguccaauuaugauauagaccacauugugccucagucuuucaucaccgauaacucgaucgacaacuuaguacucacaagcuccgcagggaaucgggagaagggagacgaugugccaccccuggagauuguucguaaaagaaaggucuuuugggaaaaacuuuuccagggcaaccugaugucaaagaggaaguuugacuacuugaccaaagcugagcgcggugggcucacugaagccgauaaggcgacauucauccaucggcaacugguggagacgagacagauuaccaaaaauguggccaacauacuacaccagagguucaauaacgaaacugacaaucacggcaacaauauggagcagguccgaaucguuaugcugaagagugcucucgugucucaauuucgcaaacaguuccagcuguacaaggugcgggagguaaacgauuaucaucacgcacaugacgccuaccuuaauggagucguggcuaacacauugcugaagguuuauccgcaguuagaaccugaguuuguguacggcgaauaucaccaauucgauugguuuaaagccaauaaggcaaccgcgaaaaagcaguucuacacaaacauuaugcucuuuuucgcccagaaagagagaaucauugacgaaaauggggagauccugugggauaagaaguaucuugagacuaucaaaaagguccuggacuacaggcaaaugaacauagugaaaaagaccgaaauucagaaaggagaguuuagcaaggcuacgaucaagcccaaagguaacuccucaaagcuaauuccacguaaagaaaauugggauccuaugaaguacggcgggcucgacagccccaacauggccuaugcaguuaucauagagcacgcuaaaggaaagaagaaagugguauucgagaagaaaauuauccgcaucaccauuauggaacggaaggccuuugagaaagacgaaaagucuuuccuggagaaacagggcuacagacagccaaaggucuugacaaagcugcccaaauauacuuuauacgaaugcgagaaugguaggcgacggaugcucgcauccgccaacgaggcucaaaaggggaaucagcagguccugaaaggccagcuuauaacccuguugcaucacgcgaagaacugugaagccagugauggaaaaagccucgacuauaucgagucuaaucgcgaaauguucggcgagcugcuagcacauguguccgaauuugcuaagagauacacacuggccgaugccaaccuuucaaagauuaaucaacucuucgagcagaacaaagacaaugauaucaaggugauugcucagaguuuuguuaaccugauggcauucaaugccaugggggcgccugcuagcuuuaaauucuuugaggccacuaucgaaaggaagcgguauaccaacuugaaagagcuguuaucggcaacgauaaucuaccaguccauuacaggacucuacgaagcccgaaagagacuggacggcuga

SEQ ID NO: 2957 - RNA, 4005 nt, Artificial Sequence
  Cas9 variant
augaagaaccccuacaccaucggccuggacauugggacaaauagcgugggaugggccguccucacuaaccaguaugaucuuguuaaaagaaagaugaaaguggcugguaauuccgacaagaaacaaauaaagaagaacuucuggggcguaaggcuguuugaugacgggcagacggcaguggaucggcgcaugaaucgaaccgcccguagaaggaucgagcggcgcagaaacaggauuucuuacuugcaggaaaucuucgcggucgagauggcuaauauugacgccaacuuuuucugccgguuaaaugauucauuuuauguggacagugaaaaacgcaacagccgacacccuuucuuugcaacaaucgaggaagagguugccuaccaugauaauuauagaacuauauaccaccugagggaggagcuagugaacuccucugaaaaggcugaccuccggcuggucuaucuugcacuggcccauaucauuaaauaccguggaaauuucuugaucgaaggcgcucucgauaccaagaacacaucgguggacgagguauacaaacaguuuauucaaaccuauaaucagguuuucaugucaaacaucgaggaaggugcccuggcgaagguggaggaaaaccuggaggucgcaagcauacucgccgggaaguuuacucgcagagaaaaauucgagaggauuuuacggcuguacccaggagagaagaguacaggcauguuugcucaguucaucucccuuauugugggcaauaaagggaacuuccagaagguguuuaauuuggucgagaaaaccgauaucgaaugugccaaggacucuuaugaagaggaccuggaagcacuacucgcuaucauuggagaugaguacgccgagcuguucguugcggccaaaaacacguauaaugcagugguacuuagcuccauaaucacugugaccgcuacagaaacuaacgccaagcugucagcuaguaugauugagcgauuugacgcccacgaaaaggauuugggugagcucaaagcauucaucaagcugcauuuaccgaaacaauaccaggaaauauuuaauaacgccgcuauugacggcuaugcgggguacaucgauggaaagaccaaacaggucgacuucuacaaguaucugaagacaacccucgagaauguggagggcgcagauuacuuuaucacgaaaauugaagaggaaaacuuccuucgcaagcagagaacuuuugacaaugguguuaucccccaccaacugcacuuggaggagcuagaagccauucugcaucagcaggcuaaauauuacccuuuccucagggaggauuaugaaaagauaaaaagccuggugacauuucggaucccauacuucgucgggccccuugccaagggacaaucugaguuugcauggcugacccgcaaggccgacggcgaaauuagaccuuggaacaucgaggagaaaguggauuucggcaaguccgcuguagacuucaucgagaaaaugacuaauaaggacacauauuugccaaaagaaaacguucuccccaagcacucacugugcuaccagaaguacaugguguauaaugaauuaaccaaagucagguacauugaugaccaggggaagacgaacuauuuuagcggacaggagaaacaacagauauucaacgaucuguuuaagcagaaacguaaggugaaaaagaaggaccuagaacucuuccugcggaauaucaaccauauugagaguccuaccaucgagggucuugaagauucuuuuaaugccuccuacgcaacauaucacgacuugcugaaagucggcaugaagcaggagagccucgauucgccacugaacgcggaaaugcuugaggacauugugaaaauccugacuguuuucgaagauaagcgaaugauaaaagagcaauugcagcaguuuucugacgugcucgaugggguaguccugaagaaguuagagagaaggcacuacaccggauggggccgccuguccgcuaaacuacucguggguauccgggacaagcagucacaucugacaauucuugauuauuugaugaaugacgacgggcugaacagaaaucucaugcaacugaucaacgauaguaaucugagcuucaaauccauuaucgaaaaggagcagguuucuacuaccgacaaagauuuacagagcauaguggccgaccuugcaggcucaccggccauuaagaagggaaucuugcagagucucaaaauugucgaugaacugguguccaucaugggcuaucccccucaaacaauaguaguggagauggcuagggagaaccagaccacuguuaaggggaaaaauaacagccgcccacgauacaagucucuagaaaaagccaucaaggaguuuggaucacagauucugaaggaacaccccacggacaaucaagagcucaaaaacaaucggcuguaccuuuacuauuugcagaacgguaaggauaucuacacaggccaggaacuggacauucauaacuuaaguaauuaugauaucgaccacauagucccucagagcuucauuaccgauaacuccaucgacaaucucgugcugacuucuucggcagggaaccgugagaaaggaggcgaugugccaccccuugagaucgucagaaagaggaaaguguuuugggaaaagcuguaccaagguaauuugaugagcaaacgcaaguucgacuaucucaccaaggcugagagagggggccugacagacgccgauaaagcgcgguuuauucauaggcagcuaguugaaacccgacagaucacuaagaacguggccaauauucugcaccagcgcuucaacaaugagacagacaacuacggaaauacgauggaacaaguacggauagucacccucaaauccgcucuggugucacaguucagaaagcaguuucagcuuuacaaaguuagggaggugaacgauuaucaccaugcacacgacgccuacuugaauggcgucguggcuaacacucuguuaaagguuuauccgcaacucgagccugaguucguguacggggaauaucaucaguuugauugguucaaggccaauaaagcaacagcgaagaaacaguuuuacaccaacaucaugcuguucuuugcccaaaaggaacguauuaucgacgagaacggagaaauucuuugggauaaaaaguaucuggagacaaucaagaaaguacuagacuaccgccagaugaauauagucaagaaaacugagauccagaagggugaguucaguaaagcuaccauuaagcccaagggcaacucuagcaaacucaucccacggaaggaaaauugggauccuaugaaauacgggggacuggacucccccaacauggccuaugcagugauuaucgaacacgcuaagggcaaaaagaagauagugauugagaaaaaguugauccagaucaauauuauggagagaaaaauguuugaaaaggaugaggaagccuuccuggaggaaaaagguuacaggcacccaaaggucuuaacgaaacuccccaaguauacccuguacgagugugagaaggggcgacggcgcaugcuugcaucagccaacgaagcucaaaaaggcaaucagcugguuuugagcaaccaucucgugucucugcuauaucacgcgaagaauugcgaggccuccgacggaaaaagucugaaguacauagaagcacauagagaggcuuuuagcgaacuucucgcccagguaucugaguucgccacaagguauacucuggcugacgcaaacuuguccaaaaucaauaaccuguucgagcagaauaaggaaggcgauauuaaggccaucgcgcaaucauuuguggacuuaauggucuucaacgcuaugggggccccugcaaguuuuaaauucuuugaggccaccauugaucggaagcgauacacaaaucucaaagaacugcuuagcucgacuaucauauaccaguccaucaccggacuguaugagucuagaaagcgcuuggacgauuga

SEQ ID NO: 2958 - RNA, 4005 nt, Artificial Sequence
  Cas9 variant
augaagaaccccuacaccaucggccuggacauugggacaaauagcgugggaugggccguccucacugaucaguaugaccuuguuaaaagaaagaugaaaguggcugguaacuccgauaagaaacaaauaaagaagaauuucuggggcguaaggcuguuugacgagggggaaacggcagccgaucggcgcaugaaccgaaccgcgcguagaaggaucgagcggcgcagaaauaggauuucuuacuugcaggaaaucuucgcuuuagagauggccaacauugacgcaaacuuuuucugccggcugaaugauucauuuuauguggacagugaaaaacgcaauagccgacacccuuucuuugccacaaucgaggaggaagucgcuuaccauaagaacuauagaacuauauaccaccuaagggaggaacucguuaauuccucugagaaagcagaucugcggcuuguguaucuggccuuggcucauaucauuaaguaccguggaaacuuccucaucgagggcgcccuggacaccaaaaauacaucgguggauggugucuacaagcaguuuauucagaccuauaaccaaguguucaucucaaauauagaagaggggacucuggcgaagauggaagagaacacaaccguagcaaacauucucgccggaaaauuuacgcgcaaggaaaaauuagagagaauccugcagcuuuacccaggcgaaaagagcacuggcauguucgcucaguuuauuaguuugaucguuggguccaaaggaaauuuccagaagguguucgaccuggucgagaaaaccgauaucgagugugccaaggacucuuaugaagaggaccuagaagcacuccuggcuauuauaggugaugaguacgccgagcuuuuuguggcggccaagaacacauauaaugcagugguccugagcuccaucauuacuguuaccgacacagaaaccaacgcuaaauugucagccaguaugaucgagagguucgaugcucacgaaaaggaccucagcgagcugaaagccuuuauaaaguuacaucugccgaaacaauacgaagagauuuucucuaauguggcaaucgauggcuaugccggguacaucgacggaaagacgaagcagguagauuuuuacaaauaucucaagacucuucuggagaacauugaaggcgcugacuacuucaucgcgaaaauugaggaagagaacuuuuugcggaagcagcgaacauucgauaauggugcaauaccccaccagcuacaccuggaggaacucgaggccauccugcaucaacaggcuaaauauuacccuuuucuuaaggaagccuaugacaagauuaaaucccuggugaccuuccgcaucccauacuuugucgggcccuuggcaaauggacagucagauuucgccuggcucacuagaaaggcugacggcgagaucaggccuuggaacauugaagagaaaguggacuuuggcaagagcgccguugauuucauagagaaaaugacaaauaaggacaccuaucugccaaaggaaaacguguuacccaaacacagucuguacuaccaaaaguauauggucuacaaugagcuaacgaaagugcgguauaucgaugaccaggggaagaccaacuacuucucuggacaggaaaaacagcaaauuuuuaaugauuauuucaagcagaaacgcaagguauccaagaaagaccucgagcaguuucugagaaacaugagccauaucgaaucgccuacaauugagggucuugaggauucuuucaacuccucauacgcaacuuaucacgacuugcugaagguuggcaucaaacaggaagugcucgagaauccacugaacauggaaaugcuugaggauauagucaagauccugaccguguuugaagacaaaaggaugauuaaggagcaauugcagcaguucagugggguccucgauggagcggugcugaagaaauuagagcgucggcacuacacaggcuggggucgacugagcgcuaagcuacucguugggaucagagacaaacagucccaucugacuauucuugauuacuugaugaaugacgacggccugaacaggaaucucaugcaacugaucaacgauucuaaucugagcuuuaagucaauaauugaaaaagaacaggugaguaccacagacaaggauuuacaguccaucguagccgaccuugcaggaagcccggccauuaagaaaggcaucuugcagucucucaagauagucgaugaacuggugucaaucaugggguaucccccucaaaccauuguuguggagauggcucgcgagaaccagacuacggucaaaggaaagaauaacagucggccaagauacaaaagccuagaaaaggccaucaaggaguucgguucccagauucugaaagaacaccccacagacaaucaagagcucaggaacaaucgccuguaucuuuacuauuugcagaacggcaaggauauguacaccgggcaggaacuggacauccauaauuuaucuaacuaugauauagaccacauugugccucagucguuuaucacugauaacagcaucgacaaucucguacugaccuccucagcaggaaaccgagagaaaggcgaugacgugccaccccuugagauuguucggaagcguaaagucuucugggaaaagcuguuucaagguaauuugaugaguaaaagaaaguucgacuaccucacaaaggcugagcgcgggggccugaccgaagccgauaaagcgacuuuuauccauaggcagcuaguggagacacggcagauuacgaagaacguggccaauauacugcaccagagauucaacaaugaaaccgacaaccacggaaauaacauggagcaagucaggaucguuaugcucaaaucugcucuggugagccaguuccgaaagcaguuucagcuuuacaaagugcgcgagguaaaugauuaucaucacgcacaugacgccuacuugaacggcgucguggcuaauacucuguuaaagguuuauccgcaacucgaaccugaguucguguacggggaauaucaccaguuugauugguucaaggccaacaaagcaacagcgaagaaacaguuuuacaccaauauuaugcuguucuuugcccaaaaggagcggaucauugacgaaaacggagagauccuuugggauaaaaaguaucuggagacaauaaagaaaguccuagacuacagacagaugaacaucgugaagaaaacugaaauucagaagggugaguucuccaaagcuaccaucaagcccaagggcaauucaagcaaacucauuccaaggaaggaaaacugggauccuaugaaauacgggggacuggacucucccaauauggccuaugcaguuaucauagagcacgcuaagggcaaaaagaagauuguguuugagaaaaagaucauccguauuacgauaauggaacgcaaagccuucgagaaggaugaaaaauccuuuuuggagaagcaggguuaccggcaaccaaaaguacugaccaaguuacccaaguauacacucuacgaaugcgagaacgggagaaggcgaaugcuggcaagugccaaugaggcucagaaaggcaaccagcagguccuuaagggacaacugaucacuuugcuccaucacgcgaaaaauugugaagccagcgacggcaagucucuggacuauauugaguccaaccgggaaauguucggggagcuacuggcacaugugucagaguucgcuaaacgcuacacccuugccgaugccaaucucaguaagaucaaccagcuguuugagcagaauaaggacaacgauauuaaagugaucgcucagagcuucgucaauuugauggcauuuaacgccaugggagcgccugcuucguucaaguuuuucgaggccacaauagaaagaaaaagguauacuaaucugaaggaguuacuccgggcaaccaucauuuaccaauccaucacgggccuguacgaagcccgaaaaagacuugacgguuga

SEQ ID NO: 2959 - RNA, 4005 nt, Artificial Sequence
  Cas9 variant
augaagaaccccuacaccaucggccuggacauugggacaaauagcgugggaugggccguccucacugaucaguaugaccuuguuaaaagaaagaugaaaguggcugguaacuccgauaagaaacaaauaaagaagaauuucuggggcguaaggcuguuugacgagggggaaacggcagccgaucggcgcaugaaccgaaccgcgcguagaaggaucgagcggcgcagaaauaggauuucuuacuugcaggaaaucuucgcuuuagagauggccaacauugacgcaaauuucuucugccggcugaacgauucauuuuauguggacagugaaaaacgcaauagccgacacccuuucuuugccacaaucgaggaggaagucgcuuaccauaagaacuauagaacuauauaccaccuaagggaggaacucgugaauagcucugagaaagcagaucugcggcuuguuuaucuggccuuggcucauaucauuaaguaccguggaaacuuccucaucgagggcgcccuggacaccaaaaauacaucgguggauggugucuacaagcaguuuauucagaccuauaaccaaguguucaucucaaauauagaagaggggacucuggcgaagauggaagagaacacaaccguagcagacauucucgccggaaaauuuacgcgcaaggaaaaauuagagagaauccugcagcuuuacccaggcgagaaaagcacuggcauguucgcucaguuuauuaguuugaucguuggguccaaaggaaacuuccagaagguguucgaucuggucgagaaaaccgacaucgagugugccaaggacucuuaugaagaggaucuagaagcacuccuggcuauuauaggugacgaguacgccgagcuuuuuguggcggccaagaauacauauaacgcagugguccugagcuccaucauuacuguuaccgauacagaaaccaaugcuaaauugucagccaguaugaucgagagguucgacgcucacgaaaaggaucucagcgagcugaaagccuuuauaaaguuacaucugccgaaacaauacgaagagauuuucucuaacguggcaaucgacggcuaugccggguacaucgauggaaagacgaagcagguagacuuuuacaaauaucucaagacucuucuggagaauauugaaggcgcugauuacuucaucgcgaaaauugaggaagagaacuuuuugcggaagcagcgaacauucgacaauggugcaauaccccaccagcuacaccuggaggaacucgaggccauccugcaucaacaggcuaaauauuacccuuuucuuaaggaagccuaugauaagauuaaaucccuggugaccuuccgcaucccauacuuugucgggcccuuggcaaacggacagucagacuucgccuggcucacuagaaaggcugacggcgagaucaggccuuggaauauugaagagaaaguggauuuuggcaagagcgccguugacuucauagagaaaaugacaaacaaggauaccuaucugccaaaggaaaauguguuacccaaacacagucuguacuaccaaaaguauauggucuacaacgagcuaacgaaagugcgguauaucgacgaucaggggaagaccaauuacuucucuggacaggaaaaacagcaaauuuuuaacgacuauuucaagcagaaacgcaagguauccaagaaagaucucgagcaguuucugagaaauaugagccauaucgaaucgccuacaauugagggucuugaggacucuuucaacuccucauacgcaacuuaucacgauuugcugaagguuggcaucaaacaggaagugcucgagaacccacugaauaccgaaaugcuugaggacauagucaagauccugacaguguuugaagauaaaaggaugauuaaggagcaauugcagcaguucagugacguccucgauggggcggugcugaagaaauuagagcgucggcacuacacuggauggggccgacugagcgcuaagcuacucguugguaucagagacaaacagucccaucugaccauucuugacuacuugaugaacgaugacgggcugaauaggaaccucaugcaacugaucaaugauucuaacuuauccuuuaagucaauaauugaaaaagaacaggugaguacaaccgacaaggaucugcaguccaucguagccgaccuugcaggcagcccggccauuaagaaaggaaucuugcagucucucaagauagucgaugaacuggugucaaucaugggcuaucccccucaaacuauuguuguggagauggcucgcgagaaucagacgacagucaaagggaagaacaauagucggccaagauacaaaagccuagaaaaggccaucaaggaguucggaucccagauucugaaagaacaccccaccgacaaccaagagcucaggaauaaccgccuguaucuuuacuauuugcagaaugguaaggauauguacacuggccaggaacuggacauccauaacuuaucuaauuaugauauagaccacauugugccucagucguuuaucaccgauaacagcaucgacaaccucguacugacauccucagcagggaaucgagagaaaggagacgaugugccaccccuugagauuguucggaagcguaaagucuucugggaaaagcuguuucaaggcaacuugaugaguaaaagaaaguucgacuaccucaccaaggcugagaggggugggcugacugaagccgauaaagcgacauuuauccaucgccagcuaguggagacgcggcagauuaccaagaauguggccaacauacugcaccagagauucaauaacgaaacugacaaucacggcaacaauauggagcaagucaggaucguuaugcucaaaucugcucuggugagccaguuccgaaagcaguuucagcuuuacaaagugcgcgagguaaacgauuaucaucacgcacaugacgccuacuugaauggagucguggcuaacacacuguuaaagguuuauccgcaacucgaaccugaguucguguacggcgaauaucaccaguuugauugguucaaggccaauaaagcaaccgcgaagaaacaguuuuacacaaacauuaugcuguucuuugcccaaaaggagcggaucauugacgaaaauggggagauccuuugggauaaaaaguaucuggagacuauaaagaaaguccuagacuacagacagaugaacaucgugaagaaaaccgaaauucagaagggagaguucuccaaagcuacgaucaagcccaaggguaacucaagcaaacucauuccaaggaaggaaaauugggauccuaugaaauacggcgggcuggacucucccaacauggccuaugcaguuaucauagagcacgcuaagggaaagaagaaggugguauuugagaaaaagauuauccguaucaccauuauggaacgcaaagccuucgagaaggacgaaaaauccuuuuuggagaagcagggcuaccggcaaccaaaaguccugacaaaguuacccaaguauacucucuacgaaugcgagaaugguagaaggcgaaugcuggcaagugccaacgaggcucagaaagggaaucaacaggugcuuaagggccagcugauaaccuugcuccaucacgcgaaaaacugugaagccagcgauggaaagucucuggacuauaucgaguccaaucgggaaauguucggcgagcuacuggcacaugugucagaauuugcuaaacgcuacacacuugccgaugccaaccucaguaagauuaaucagcuguuugagcagaacaaggacaaugauaucaaagucauugcucagagcuucguuaacuugauggcauuuaaugccaugggggcgccugcuucguucaaguuuuucgaggccacuaucgaaagaaaaagguauaccaaccugaaggaguuacucuccgcaacgauaaucuaccaaucuauuacaggacuguacgaagcccggaaacgacuugacggcuga

SEQ ID NO: 2960 - RNA, 4005 nt, Artificial Sequence
  Cas9 variant
augaagaaccccuacaccaucggccuggacauugggacaaauagcgugggaugggccguccucacuaaccaguaugaucuuguuaaaagaaagaugaaaguggcugguaauuccgacaagaaacaaauaaagaagaacuucuggggcguaaggcuguuugaugacgggcagacggcaguggaucggcgcaugaaucgaaccgcccguagaaggaucgagcggcgcagaaacaggauuucuuacuugcaggaaaucuucgcggucgagauggcuaauauugacgccaacuuuuucugccgguuaaaugauucauuuuauguggacagugaaaaacgcaacagccgacacccuuucuuugcaacaaucgaggaagagguugccuaccaugauaauuauagaacuauauaccaccugagggaggagcuagugaacuccucugaaaaggcugaccuccggcuggucuaucuugcacuggcccauaucauuaaauaccguggaaauuucuugaucgaaggcgcucucgauaccaagaacacaucgguggacgagguauacaaacaguuuauucaaaccuauaaucagguuuucaugucaaacaucgaggaaggugcccuggcgaagguggaggaaaaccuggaggucgcaagcauacucgccgggaaguuuacucgcagagaaaaauucgagaggauuuuacggcuguacccaggagagaagaguacaggcauguuugcucaguucaucucccuuauugugggcaauaaagggaacuuccagaagguguuuaauuuggucgagaaaaccgauaucgaaugugccaaggacucuuaugaagaggaccuggaagcacuacucgcuaucauuggagaugaguacgccgagcuguucguugcggccaaaaacacguauaaugcagugguacuuagcuccauaaucacugugaccgcuacagaaacuaacgccaagcugucagcuaguaugauugagcgauuugacgcccacgaaaaggauuugggugagcucaaagcauucaucaagcugcauuuaccgaaacaauaccaggaaauauuuaauaacgccgcuauugacggcuaugcgggguacaucgauggaaagaccaaacaggucgacuucuacaaguaucugaagacaacccucgagaauguggagggcgcagauuacuuuaucacgaaaauugaagaggaaaacuuccuucgcaagcagagaacuuuugacaaugguguuaucccccaccaacugcacuuggaggagcuagaagccauucugcaucagcaggcuaaauauuacccuuuccucagggaggauuaugaaaagauaaaaagccuggugacauuucggaucccauacuucgucgggccccuugccaagggacaaucugaguuugcauggcugacccgcaaggccgacggcgaaauuagaccuuggaacaucgaggagaaaguggauuucggcaaguccgcuguagacuucaucgagaaaaugacuaauaaggacacauauuugccaaaagaaaacguucuccccaagcacucacugugcuaccagaaguacaugguguauaaugaauuaaccaaagucagguacauugaugaccaggggaagacgaacuauuuuagcggacaggagaaacaacagauauucaacgaucuguuuaagcagaaacguaaggugaaaaagaaggaccuagaacucuuccugcggaauaucaaccauauugagaguccuaccaucgagggucuugaagauucuuuuaaugccuccuacgcaacauaucacgacuugcugaaagucggcaugaagcaggagagccucgauucgccacugaacgcggaaaugcuugaggacauugugaaaauccugacuguuuucgaagauaagcgaaugauaaaagagcaauugcagcaguuuucugacgugcucgaugggguaguccugaagaaguuagagagaaggcacuacaccggauggggccgccuguccgcuaaacuacucguggguauccgggacaagcagucacaucugacaauucuugauuauuugaugaaugacgacgggcugaacagaaaucucaugcaacugaucaacgauaguaaucugagcuucaaauccauuaucgaaaaggagcagguuucuacuaccgacaaagauuuacagagcauaguggccgaccuugcaggcucaccggccauuaagaagggaaucuugcagagucucaaaauugucgaugaacugguguccaucaugggcuaucccccucaaacaauaguaguggagauggcuagggagaaccagaccacuguuaaggggaaaaauaacagccgcccacgauacaagucucuagaaaaagccaucaaggaguuuggaucacagauucugaaggaacaccccacggacaaucaagagcucaaaaacaaucggcuguaccuuuacuauuugcagaacgguaaggauaucuacacaggccaggaacuggacauucauaacuuaaguaauuaugauaucgaccacauagucccucagagcuucauuaccgauaacuccaucgacaaucucgugcugacuucuucggcagggaaccgugagaaaggaggcgaugugccaccccuugagaucgucagaaagaggaaaguguuuugggaaaagcuguaccaagguaauuugaugagcaaacgcaaguucgacuaucucaccaaggcugagagagggggccugacagacgccgauaaagcgcgguuuauucauaggcagcuaguugaaacccgacagaucacuaagaacgugacaaauauucugcaccagcgcuucaacaaugagacggacaacuacggaaauaccauggaacaaguacggauagucacucucaaauccgcccuggugucacaguucagaaagcaguuucagcuuuacaaaguuagggaggugaacgauuaucaccaugcucacgacgcauacuugaauggcgucguggccaacacacuguuaaagguuuauccgcaacucgagccugaguucguguacggggaauaucaucaguuugauugguucaaggcuaauaaagccaccgcaaagaaacaguuuuacacaaacaucaugcuguucuuugcgcaaaaggaacguauuaucgacgagaacggagaaauucuuugggauaaaaaguaucuggagacuaucaagaaaguacuagacuaccgccagaugaauauagucaagaaaaccgagauccagaagggugaguucaguaaagccacgauuaagcccaagggcaacucuagcaaacucaucccacggaaggaaaauugggauccuaugaaauacgggggacuggacucccccaacauggcuuaugccgugauuaucgaacacgcaaagggcaaaaagaagauagugauugagaaaaaguugauccagaucaauauuauggagagaaaaauguuugaaaaggaugaggaggcuuuccuggaagaaaaagguuacaggcacccaaaggucuuaaccaaacuccccaaguauacacuguacgagugugagaaggggcgacggcgcaugcuugccucagcaaacgaagcccaaaaaggcaaucagcugguuuugagcaaccaucucgugucucugcuauaucacgcuaagaauugcgaggcguccgacggaaaaagucugaaguacauagaagcccauagagaggcauuuagcgaacuucucgcucagguaucugaguucgccacuagguauacccuggccgacgcuaacuuguccaaaaucaauaaccuguucgagcagaauaaggaaggcgauauuaaggcaaucgcccaaucauuuguggacuuaauggucuucaacgcgaugggggcuccugccaguuuuaaauucuuugaggcaacaauugaucggaagcgauacacuaaucucaaagaacugcuuagcucgaccaucauauaccaguccaucacgggacuguaugagucuagaaagcgcuuggacgauuga

SEQ ID NO: 2961 - RNA, 4005 nt, Artificial Sequence
  Cas9 variant
augaagaaagaguacaccaucggccuggacauugggacaaacagcgugggaugggccguccucacugaaaauuaugaucuuguuaagaaaaagaugaaaguguacgguaacacggagaccaaguaucugaagaaaaauuuguggggcguaagauuauucgacgaaggggagacagcugcagauaggcggcugaagcgcacuacccgacguagauacuccaggcggcgcaacagaauaugcaggcuacaggaccucuuuacagaagagaugaaucaaguggaugccaacuucuuucaccggcugcaggagucuuuccuuguccccgacgaaaaagaguuugaacgccaugcgaucuucggaaagauggaggaggaagugucauauuaccgagaguuuccuaccauuuaucaccugagaaaacauuuggcugauacuagcgaacaggccgaccucaggcugguuuaccuggcacucgcccacaucgugaaguaccggggccauuucuuaauugagggugaacugaauacagagaacagcuccgucucugagaccuuucguacguucauccagguguauaaucaaauauuucgcgaaaacgagguaccacuugcuguuccggauaauaucgaagaguuguucucggaaaaggugucaagagcaaggaaagucgaggccauucugagcguguacagugaggaaaaguccacugggacccuagcucaguuucucaaacugauggugggaaaccagggccgguucaagaaaacauucgaccuugaggaagauggcaucauucagauccccaaggaggaauaugaggaggaacuggagacuuugcucgccauaauuggggacgaauacgcggagaucuuuucugcaaccaaaagcgucuaugaugccguugcucuguccggaauuuuaucagugacagacggugacaccaaggccaagcugagugcaagcaugguagagcgauacgaagcucaccaaaaagaucucgugcaguucaagcaguuuauccgcaaagagcuuccugaaauguaugccccaaucuucagagacaauucugucuccggcuacgcgggguacguggagaacucaaagguugugacgcaggccgaauuuuauaaauacauuaagaaggcaauagagaaaguccccggagcugaguauuuccuggaaaagaucgagcaagaaacuuucuuggauaaacagaggacauucaauaacggcgugauuccucaccagauccaucuagaggaacuggaggccauaauucaaaagcaggcuaccuacuauccauuucucgccgacaacaaagaggaaaugaagcagcugguaacuuuccggauccccuacuauguugguccucuugcagaugggaauagcccauuugccuggcuggagcgcaucaguucugaaccgauuagacccggaaacuuggcugagguggucgacaucaagaaauccgcgacaaaguucauugaaaggaugaccaauuuugauacguaccucccuaccgagaaagugcugccaaagcacagcaugauauacgagaaauauauggucuacaacgaauuaacaaaggugucguauguugacgagcguggcaugaaucagcgguucucuggcgaagagaagaaacaaaucguggaggaacuguucaagcagucccgaaaaguaacuaagaaacuacucgagaaguuucugucaaacgaauuugggcuugucgauguggcaauuaaaggaaucgagaccaguuuuaaugccgguuacggcacauaucaugacuucuugaagaucgggauuacuagagaacagcuggauaaggaggagaacagcgaaacccucgaggaaauaguuaaaauccugacaguguuugaggacaggaagaugauucgcgaacagcuuaaaaaguacaccuaucuguucgacgaggaggucuugaaaaagcucgaacggagacacuacacuggauggggcaggcuguccgcuaaguuacugaucgguauuaaagagaagcgcacgcacaaaacaauccuagauuaccucauagaagacgaugggggcaagcaacccaucaaucgaaaccugaugcagcuuauuaaugacucugauuugagcuuuaaaucagagaucgccgaagcacagagugacaugaacaccgaggaucugcaugaggugguacagaaucucgccggauccccugcuauuaagaagggcauccugcaaaguuuaaaaauaguggacgaacugguugauauuauggggucucuuccaaagaacaucgucguggagauggcccgggaaaaucagacuaccucacguggaagaacaaacaguaaccccaggaugaaagcauuggaggaggcgaugcgcaaucuccggagcaaccugcuaaaggaauauccgaccgacaaucaggcucugcagaacgauagacucuaccuguauuaccuucaaaaugguaaagacauguauacuggcuuggaucuguccuuacacaaccucucuucguacgacauugaccauaucgugccucagagcuucacaacggauaauucccuggacaacaggguccuuguuucaaguaaggagaaucgagggaagaaagaugacgugcccucuaaggaagugguacagaaaaacauaacccugugggagacuuugaagaauagcaaccucaucucccaaaagaaguaugauaaucugacaaaaggacuacgcggcggucugaccgaagacgaucgggcccacuuuauuaagagacagcucgucgagacaaggcagaucacuaagcauguggcacguauucuggaccagcgcuucaacucacaaaaagaugaggaagggaagaccauccgggccguuagaguggucacgcuuaaaagcucuuugaccucccaguuuaggaagcaguucgcuauacacaaagugcgagagauuaaugacuaccaccauggccacgaugccuaccugaacggaguuguggcaaacaguuuacuccggguauauccacagcugcaaccugaauuugucuacggcgacuaucccaaguucaaugcuuacaaggccaacaaagcgacagccaagaaacagcuuuauacuaauaucaugaaguucuuugcugaggaugcagugaucauugacgaaaacggggagauccugugggacaaaaagaauauugccaccgugaagaaagucaugagcuacccacagaugaacauaguuaagaaacccgagauccagacaggaucuuucuccaaggaaacuauuaaaccuaagggugauucagacaagcuaaucagucgcaaaaccaauuggagcccaaagcucuauggcggguuugauucgccgcaaguggcuuacuccguaauuaucacguacgagaaaggaaagaaaaaggugagagccaaggcaauagucggcaucacaauuauggaacagucucuguucaaaaaggaccccgugagcuugcuggaggaaaaagguuaugcgaacccugagguuuuaauccaucucccaaaguacacccuguaugagcuugaaaaugggaggcggcgacuguuggccucagcuaacgaggcccagaaaggcaaucaacucgugcugcccgcaagucuagucacucugcuuuaccacgcuaaacagguggaugaagacuccggaaaaucugaggaguauguuagagaacaccgcgccgaguuugcagaaauucucaacuacgugcaggccuucagcgagacaaagauccuggcuaauaagaacuugcagaccauacugaaauuauaugaagagaauaaggaggcggauauuaaagaaaucgccgaguccuuugucaaccucaugaaguucucagcauacggcgcuccuauggacuuuaaauucuuugggaagacuaucccaaggagccguuacaccaguguaggagaacugcuuucugccacaauuauaaaccaauccaucacgggccuguaugagacccggagaaaguugguggauuga

SEQ ID NO: 2962 - RNA, 4005 nt, Artificial Sequence
  Cas9 variant
augagaaagcccuacaccaucggccuggacauugggacaaacagcgugggaugggccguccucacugaucaguauaaucuuguuaaaaggaagaugaaaguggcugguuccgcagagaagaaacaaauaaagaagaacuucuggggcguacggcuguuugacgaaggggagguggccgcgggacgccgaaugaaucguacgaccagaaggcggaucgaacgcagaaggaaccggauugcuuacuugcaggagaucuucgccgcagaaauggccgaggucgaugcuaauuucuucuaucgcuuagaggacucuuuuuacauugaaucagagaaacgacacaguagacauccuuucuuugcaacaaucgaagaggagguggccuaucacgaagaguacaagacuauauaucaucugagggaaaagcuaguuaacagcuccgauaaagcugaccuccggcugguguaccuugcccuggcgcacaucauuaaauaccguggcaauuucuugaucgaggguaugcucgauaccaagaacacaucugucgacgaaguguuuaagcaguucauucagaccuauaaucaaaucuuugcaucggauauagaggaggggucacugacucgccuggaagagaacaaagaaguagccgagauucucagcgaaaaguuaacaagaagggagaaacuggacaagauccuuaaauuguacaccggagagaagaguacgggcauguucgcucgguuuauuaaucugaucaucggcuccaaaggggauuucaagaagguuuucgaccuagaugaaaaagccgagauugaaugcgcaaaggacacuuaugaggaagaccucgaggcucugcuugccaaaauaggagaugaguacgcggaaaucuuuguggccgcaaagucuaccuauaacgcugucgugcugagcaauauuaucacagugacugacaccgagacaaaagccaaguuguccgcuucaaugauagaacgauucgauaagcaugccaaagaccucaagcgccugaaagcauuuuucaagaugcaguuaccagagaaauuuaacgaggucuucaaugauauugaaaaggacgguuacgccggcuauaucgaugggaagaccacgcaggagaaauuuuacaaguacaugaaaaagaugcuggcuaacaucgacggagcggauuauuucauugaccagaucgaagaggaaaacuuucucagaaaacaaaggacuuucgauaauggcacaauuccgcaccagcuucaccuggaggaguuggaagcaauacuacaucagcaggccaaguacuaucccuuucugcggaaggacuacgagaaaauccgcagucucguuaccuucagaaucccuuauuuuauugguccacuggcuaacgggcaaagcgacuucgccuggcuuacuaggaaggcagauggagaaauccgucccuggaauauugaggaaaaaguggacuucggcaagucugccauagauuuuaucgagaaaaugacaaacaaggacaccuaccugccuaaagagaauguauugccaaagcacucccucuguuaucagaaguacaugguguacaacgaacugacgaaaauucgguauaucgaugaccagggcaagacccaucacuucucagggcaagagaaacagcagauuuuuaauggauuauucaagcagcaacgaaaagucaagaagaaagaucuggaaagauuucuauacacaaucaaccacauagagagccccacuaucgaagguguggaggacgcuuucaauaguucuuuugccaccuaucaugaucuccagaagggcgggguuacacaggagauucuggacaacccucuuaaugcagauauguuggaagagaucgugaaaauucugacugucuucgaagacaagaggaugaucaaagagcagcuccaauccuuuagcgaugugcuggacggaaccauacuuaagaagcuggagcgccggcacuacacaggcugggguagauugucggcgaaacuccugaccgggauuagggacaagcauucucacuuaacuauccuggauuaucuaaugaacgacgauggccucaaucgcaaccugaugcagcuuauuaaugacuccaacuugucauucaaaaguaucauagaaaaggagcagguaagcacggcugauaaaggaauccaguccauuguugccgaacuggcaggcucuccagccaucaagaaggggauucuccaaagccugaaaaucguggacgaguuagucggaauaauggguuacccgccccagacaauuguggucgaaauggcucgagagaaccagaccacuggcaaggggaaaaauaacucaaagccucgguuuaucagucuggagaaagccaucaaggaauuuggaucccagauucuuaaagagcauccaaccgauaaucaaugcuugaagaacgaccgucucuaucuguacuaccuacagaauggcaaggauauguauacagguaaagaacuggacauccacaaccucagcaauuacgauauugaccacauaaucccccagucuuuuauuaccgauaacucaaucgacaauagagugcugguuaguagcacugcaaacagggagaagggggacaaugugccucuuuuggaaguaguccgcaaacggaaggcuuucugggagaaacuguaucaagccaaguuaauguccaagagaaaauucgauuaccucacaaaggcggagaggggcggacugacggaagccgacaaagcuaacuuuauucagcgacagcuuguggagacccgccagaucacuaagaauguugcaaacauacuguaucaacgguucaauuguaaacaggaugaaaacggcaacgagguggaacaggucagaaucgugacauugaagucuacccucguaucgcaguuuaggaagcaauuccagcuguacaaagugcgugagguuaaugacuaucaucacgcccaugaugcuuaccuaaacggggucguggccaauacacugcucaagguguacccacagcuggagcccgaauuugucuauggagacuaccaccaguucgauugguuuaaagcaaacaaggcgacugccaaaaagcaauucuauaccaauauuaugcgcuuuuucgcuaaggagaaccagaucauugacaaaaauggugaaauccuuugggauaaccgguacuuggacacgauaaagaaaguucugagcuauagacagaugaauauugugaagaaaaccgagauccaaaagggcgaguuuuccaacgccacagugaauccgaaggggaacucaaguaaauuaaucucuaggaaggcagauuggaauccuauuaaauacggaggcuucgacgguagcaacauggcuuauuccauaguaaucgaauacgagaagcggaaaaagaaaacugucauuaagaaggaacucauccagauuaauaucauggagcgaguggccuucgaaaaagaccagaaggcauuucuggaggagaaaggguacuauucacccaagguucuuaccaaaauaccaaaguacacacuguaugaaugcgagaacggccgcagaaggaugcuaggaagcgccaacgaagcucagaagggcaaucaaauggugcucccuaaccaccugaugacuuugcuguaccaugcgaaaaauugugaggccaacgauggggaaucuuuagcauauaucgagaugcaccgggagauguucgcugaacuccuggccuacauuuccgaguuugccaagcgauauacccuugcuaaugacagacuggagaaaaucaacauguucuuugaacagaauaagaaaggagauauuaaggucaucgcaaagaguuucgacaaauugaagguguuuaacgccuucggcgcgccccgcgauuuugaguucuuugaaacgacaauaaaaaggaagcguuacuacaauauuaaagagcuccugaacgcuaccaucaucuaucagagcauuacuggucuauacgaagcccggaagagacuggaggacuga

SEQ ID NO: 2963 - RNA, 4008 nt, Artificial Sequence
  Cas9 variant
augaagaacuacaccaucggccuggacauugggacaaauagcgugggaugggccgucauaaaagaugaccucacucuuguuagaaagaaaaucaagauuuccgguaacacggauaaaaaggaggugaagaaaaaucuguggggcucuuucuuguuugaacagggggacaccgcucaagauacaaggguaaagcggaucgcacgccgacguuaugagagaaggcgguuccgcauuagagaauuacagaaaaucuuugacaagucaaugggagagguggauaguaacuucuuucacaggcuggacgagagcuuccuagucgaggaggauaaagaauacuccaaguaucccauauuuucuaaugagaaggaagacaaaaacuacuaugauaaguacccuacuaucuaucaucuccggaaagaccuggccgauucgaaucagaaggcggaccuucgccugauuuacuuggcucucgcccacaugaucaaauaccgaggccauuuccugauugagggugaccugaagauggaugggaucucaauaagcgagaguuuucaggaguucauugacuccuauaacgaagugugcgcacucgaagaugagaauuuagaaaucauuuacaacgacgagcugcuuacccaaaucgagaauaucuuuaaacaggauauuucuagaagcaagaaguuggaccaggccauagcucuguuccagggaguuaaaaggcaaucccuauuuggcaucuuccucacacugauugugggcaacaaggcaaauuuccagaaaaucuuuaaccuugaagaugacauaaagcuggauuugaaagaggaagacuaugaugagaaucucgaagaacuguuaucaaacauugacgagggguaccgggacgucuuccugcaggccaagaacguguauaaugcuaucgaacucaguaagauccuuaaaaccgauggaaaggagacuaaagccccacugagcgcgcagaugguagaauuguacaaccaacaccgugaggaccuaaagaaauauaaggauuacauuaaggcauaccugccggaaaaauauggugagacauuuaaggacgccaccaaaaauggcuacgcuggguauaucgauggaaagacgucucaggaggacuucuacaaauuuguuaaggcccagcucaagggcgaagagaacggugaauauuuccuggaggcaauugagaaugaaaacuuucuucgcaaacaaagauccuucuacaauggggugauacccuaucagauccaucugcaggaguugacugcuguccucgaucagcaagaaaagcacuacucauuucugaaagagaacagggacaagauuaucagcuuacugaccuuccggaucccuuacuaugugggaccacuagccaaaggcgaaagucgauuugcguggcucgagcgcucuaauuccgaggaaaagauuaaacccuggaacuucgauaagauaguggacaucgauaagagcgccgagcuguuuauugaaaaucuuacaucgagagacacuuacuugccugaugagccaguccugcccaaaaggucucucaucuaucagaaguucaccauuuucaacgaacugacaaaaaucuccuacauagacgagcggggcauccuucagaauuuuucaagucgcgagaagauugcaaucuucaacgaccuguuuaaaaauaagagcaagguuaccaaaaaccaguuggugaaguauauugaaaacaaagagcaaaucauagcuccugaaauuaaggggaucgaggauuccuucaauucuaacuacagcacguauauugaccucucaaaaaucccagauaugaagaagcuguuagaaaaagacgaggaugagauacuggaagagaucauuaagauccuaacuauuuuugaagacagaaaaaugaggaagcgucagcucaugaaauucaaggauaagcugagugagaaagccaucaaucagcuuuccaagaaacacuacacaggauggggucaguugagcgagaagcugauaaacggcauucgggacgaacaaucuaauaaaaccauccucgauuaccugaucgaggacaacggguguccgaagaauaugaaccgaaauuuuaugcaguuaauuaacgaugacacucugucauucaaagaaaagaucagaaaggcucaggauauuaaucagguaaacgacauaaaagagaucgugaaggaccuucccggaaguccugccauuaaaaagggcaucuaucaaagcauuaggaucgucgaugaaauaauccgcaaaaugaaggaccggccaaagaauauugugaucgagauggcaagagagaaccagacaacccaggaagguaaaaauaaguccaaagccagguugaagaaaauucaagaggggcucgaaaaccuggauucuguucauguggagaagcaggcucuagacgaagagaugcugaagucgcccaaauacuaucucuacugccugcagaacggcaaggauaucuauacgggaaaagaccuugauauaggccaguugcaaaccuacgacauugaucacaucaucccucgcagcuuuauuacagacaauuccuucgauaaccuggucuuaacuucaaguaccgugaaucgagggaagcucgacaacguaccaucucccgacauaguucggcagcagaaaggauuuuggaagcagcugcuucgugcgggucugaugagccaaagaaaguucaauaacuugacaaaaggcaagcucacugauagggaccgccagcaguuuaucaaucggcagcugguggagaccagacaaauuacaaaacaugucgcaaaccuacugucccaccaccucaaugaaaagaaagaggugggggaaaucaacauuguccugcuuaagucagccuugaccagccaguucaggaagaaauucgauuuuuauaaggugcgagagguuaaugacuaccaucacgcucaugaugccuaccugaacggagugaucgcauuaaaacuccuggaacuuuauccguacauggccaaggaccugauauauggcaaauacucuuaucaccgcaagaucgagggugauaaagcuacucaggccaaguacaagauguccaauauuaucgagcgguucagucaagaccuacucgcaaacccugauggggaaauugcgugggagaaagacaaggaucugaauacgaucagaaaaguauugagcucuaagcagauaaacauuaucaaaaaggcugaagagggcaagggaaggcuguuuaaagagacaaucaacucccgucccucaaagaaaaccgaaaagcgcauuccaaucaaaaauaacuuagacccuaauauauauggcggguacauugaggaaaagauggccuacuauaucgcaauuaacuaccucgagaauggaaagacuaaaaaggccaucgucgguauaaguauuaaagauaagaaagacuucgaaggccagaccacagaguaucuggggaagaucggauuuaacaaggcuagcaucauuaauucguucaaaaacuacacccuuuuugagcuggaaaauggcucccggagaaugaucgugggugccucuaaggagaacgacagcaaaggggaauugcagaagggcaaucaaauguaucucccccagaaccugcuagaguucguuuaccaucugaaacacuauaaugaagaugagacuucacacaaguuuauuguggagcauaaagcauacuucgacgaacuucucaacuacauagucgaguuugcuaauaaguaucuggaauuggagaacaguaucgaaaagauuaaagaucuguaccacggaaagggcccagacguggaggagaaagaauuaguagaguccuucaucaaucuccuggccaucacaaagugugggcccgcggccgauauuacguuccuuggagagaaaauaucuaggaagcgauaucggagcaccaacugccuguggggcuccgaagugaucuuucagucaccuacugguuuguacgagacacgccucagacuggaauga

SEQ ID NO: 2964 - RNA, 4011 nt, Artificial Sequence
  Cas9 variant
auggacgauaacuaccagcugaugcacgccaagggcaaauauggguacggaaccagaaucuauagcgagggucaaacagcugcagacaggcggggcuuccgcacuacgcgacguagacucaauaggcggaaguggcgccuuagacuguugcaggacuuuuucgaacccuacauuuuaccucaggaugaggccuuuuucauaaggcagaaacaauccaaccuggugccacaggauaccaagaaacaguauccggaaucuguccuauuugacgauacaucagacaaggauuucuacacugaguaucccaccaucuaccaucuccggcaggcgcugaugacagaaaaucgccaauuugacauucgagagguuuaccuugcuauccaccauauugugaaguauagagggcacuuccugaacaaugccccuguaaaaaccuuuaagaguggaaacuuggaucucgcaaucaaauucaaugagcugaacgaagaguuuaagagcguguacccagaccuggaacuccaguucaauuuagaucagauagacgagaucaaaaagauucugcuugacuccacuaagucuagguuugaucggcagggcgaggccgucaaauugaucuauacagugucggaaguuaagaccauugagaaacugcaaaacaagaucgugaaacaguuccuaucagguauacucgggcugaauacgcguuucgacguccuuacuaacaccgaaagcgaugacaguauguggaaguuuucccuggauucugagagcuccgacgaugcuuuggacgaaauuaucgcacagcucgaugaccccgccauucaugugguagagcugguuaaugagauccacucaaguaucacauuagcuggaauugugccugaaggccaaggccugagcgagucuauggucgaaaaauacgaggcccacaaggcgcaucuccagcuucugaaggcaguggaaaaauugguggauaagaaagccgcugacaagcuagaggucgccuaugaccaguacauaaacgggaaagauuccaagcaguucaucaaggaggacuuuuauaaagcaguucaaucagaaauuaagggaguggcuggugaugagguagccgaaaucaaucagcugauagagcucgaccaguucaugccaaaacagcgcacuaaggaaaacggcgcgauuccccaccaacugcaucagcacgagcuugaugugaucaucgagaaccagagcaaauacuacgacuggcugggggaaaaggucggaaaugaguauaaguuggauaaacucgugaguuuuagaguuccuuacuaugugggcccacuggucgacaccgccucuaaggagaaaaaggaugaaacaagguucgcauggauggugcggaaaaacccggaguccaccgaagcuauuacgcccuggaauuuugaggacaucguagauaagaacgccagcgcugaaaauuucauuaagcgaaugacuacaaaagacaaguacuuacugaacgaggauguucuaccuaaaugcucgcuccugacccaggacuuugaaguguauaaugagcuuaacaauauacgcgucaacggugagaaguucacugccgaacaaaaacaguugauccacgacgagcuguuuacaaagcaugcaucuguguccauuaaacagcucaaggauuuccuggucucagaacuuauguacgugagagacaaucugaagguugagggguuggccgaugagaaaaagcucaugaguagccuguccacccaguuugacuaucagaaaaucaucccagaucaaauuaacgacgugaaguacagggaagauauagagcagaucauugaauggucuacgaucuucgaggacgcugcgauuuucaaaaccaaguuaaaggaaaucgauuggcugacagacgagcaacggaauaaacuagcaaacaagcgcuacagaggauggggcagccucucaaaaaggcugcuugccuguuugguagaugaaaauggccagcguauaaucgacauucugcgggauaguuccgacaacuuuaugaugaucgucaaccgacccgaguucaagcaggcuauuuuugacgagaaugccaaccucacugaaaccaauagcaaaaaggauauguucgagaugaucgacaacuuuuauacaucuccucagaauaagaaagcaauaagacaagugcuguuaguugugcaggauauucagaacgccaugggaggggucgcuccacagaagaucuucauugaauuugccagggaggacgaggugaauggucgccggacuaacucaagauacagucaaaucagggaaauguauagcaaaguaaccgaugacgugauaaauaagacaguucgcggcgagcuggaagcaaacaaagggucccuuaauaaggagaaguuguuccucuacuuucugcagggaggcaucgaucuauauucugguaaaaccauuaacaucgacaauauuucgagcuacgaugucgaccacgugcugccccaguccuucaucaaggaugacucaauaaacaauaaagugcucgucaacgcgaaggggaaccgaguuaaaaaugacaacgugccgauggaacuguuuggcgcuaagauguauccuacuuggaaacggaugguggauacgggaauuaugaguaaggccaaguucaaaaaucuuacauugaaccccgacaauguagauaaguuuaaagcagagggcuucaucaaccgucagcuggucgagaccagacaaaucauuaaguuaguggcccagauccucaaugacaaacugggggaugacacuaagauuguuucugugaaggcuaaccuuacccaugauaugagggucuucuuugacuucccuaaaaaucgcaacgugaauaacuaccaccaugccuuugaugcauaccugagcgcuuucguuggaacauauuuguacaagcgguauccaaaacuccagcccuacuuuguguauggugaguucaagaaaauggacaagcugaagaauaugaccuccuuugauuuccuaagagaccugaaacacacugauaagguagucgacaaagacacaggcgaaauaaucgccgauaagcucgcggugauuacgaacaugaauaaaaucuacgacuuuaagaaggugcuggucacccacgaaguucaugagaacucaggggccauguaugaucaaacucuuuacccagcuaaauuggacaagagccugggaaggaaaggcgcaaagcaguuaauucccaaaaaggaugacaugccuacagcccucuacgguggguauaccggcucuaaggaugcuuucauguccaucgugcgacugaaaaagaaagacgaaguauacuauaaggugauaggaaucccaguccgcauugccgauagugugcagcacggcaaagagguugacguggaggcacuuacacaguuuaucgaaacuaaguucaccaaagagaaccugaauaagaagacgggggaaauuacccggaaagucgagugguucgagcuagugcucccgaagguucuguuuggacaagcgguguucgaugguggccagcccuuuauguuggggagcucuacauacccucauaaccugagagaauuaguccucacuaaagacuccguaaagaaaaucgccggaaaggagucaaauaagaguuaucuggaugcuuacgacgaaauaauggaggccaugaacaaauauuucccacuuuacgacaccaauaaguuuagggaaaaagugauugagggccguagcaaguucaucgaucugcccgacaaagaugaguacgaaaacaauaaguugguucagguggguaagucgacaaucauugaccgcauguuuauagggcuccacgcaaacgcugcccggacugaucugaaaaauaucggcauuaccacgccuuucggauuuaugcagcaagcauccggcaucaagcuaacaaaagacaccgucgugcuguuccagucuagcacugggcuuuuugagagaaagguagcccucaaagaucuguga

SEQ ID NO: 2965 - RNA, 4011 nt, Artificial Sequence
  Cas9 variant
augaccaaggacuacacaaucggccuggauauugggacuaacagcgugggaugggccguccucacggacgauuaucagcuuaugaaaagaaagauguccguucacgguaauaccgagaaaaagaaaauaaagaagaacuucuggggcgcuaggcuguuugacgaagggcaaacagcagaguuccggcgcacuaaacgaaccaaucguagaagguuggcccggcgcaaguacagauuaucuaaacugcaggaucuauuugcggaggaacucugcaagcaggacgauuguuucuuugugaggcuggaagagucauuccuuguacccgaggaaaaacaguauaagccugcuaguaucuuuccaacacuggaggaagagaaggaguacuaucaaaaauacccgaccauuuaucauuugcggcagaagcucguggacagcacugaaaaagaggaucugcgccuggucuaccucgccuuagcacaucugcuuaaguaccgaggacacuucuuguuugaaggcuaucuggacacagagaacaccuccaucgaagagucuuucagaguguuucuagagcaguacgguaaacagucggaucaaccccucauuguucaccagccugugcugacgauccuuacugacaagcugucaaaaaccaagaaggucgaagagauauugaaauauuacccaacagaaaagaucaauagcuucuuugcccagugccucaaacugauuguggggaaccaggcuaauuucaagaggaucuucgauuuagaggcagaaguaaaacugcaauuuaguaaggagacuuaugaggaagaccucgagucccuucuggaaaagauuggagacgaguacuuggauaucuuccuacaggccaaaaagguucaugacgcuauacugcucucugaaauuaucagcuccaccgugaaacacacacaggccaagcugucaaguggcauggucgagcgguaugagcgucacaaagcggaucuugcaaaguuuaagcaauucgugaaagaaaacgugccccagaaggccaccgucuuuuucaaagacacgacuaagaauggcuacgcuggguacauuaaaggaaagacaacccaggaggaauuuuauaaguucguuaaaaaggagcugagcggugugguaggcucugagccauuuuuggagaaaaucgaucaggaaacuuuccuccugaagcaacgcacauacaccaacggggugaucccucaucagguccacuuaauugaacugaaagccauaaucgaccagcagaagcaacauuaucccuuucuagaggaagcaggaccuaaaauuaucgcucucuucaaguuuagaauaccauacuaugugggcccgcuggccaaggagcaggaggcguccucauucgccuggauugaaaggaaaacggcagagaagauccaccccuggaauuucagcgaaguuguggauaucgagaaaagugcuaugcgguuuauucagcgaaugaccaagcaggacacauaccuuccuacugaaaaagucuugccaaagaacucucugcucuaucaaaaguacaugaucuucaaugagcugaccaaaguguccuacaaggaugagcgcgguguaaaacaguauuuuagcggggacgaaaagcagcagauuuucaaacaacuuuuucagaaggagagaggaaagauaacaguuaaaaagcugcagaacuucuuguacacucacuaucauaucgaaaaugcccacauuuuuggcaucgagaaggcuuucaacgccucguacucuaccuaucaugauuuuaugaagcucgcaaaaacaaaccaaaaguccaugcaggaauggcuggagcagcccgagauggaaccuaucuucgaggacauugugaagauauuaaccaucuuugaagacaggcagaugauuaaacaccaacugucaaaguaccaggaggucuucggcgagaaacuacucaaggaauuugcccggaaacauuauacuggguggggacgcuucagugcuaagcugauccacgguauuagagauaggaaaacgaauaagacaauccuugacuacuugauaaacgaugacgaugugccagcgaaucguaaccggaaucugaugcagcucaucaacgacgagcaccugagcuucaaggaagagauugcaaaagccaccgucuuuuccaagcauaaaucuuuaguggauguuauccaggaccugcccggcagcccggcuauuaagaaagggaucuggcaaucacuuaagauaguggaagaguugauugccaucauuggauacaagccuaaaaauaucguaauagagauggcacgagaaaaccagaagacucacagaaccaaacccaggcucaaggcccuggagaauggccuaaaacagaucgguaguacacugcucaaggaacagccaaccgauaacaaggcucugcaaaaagagcgccuuuauuuguacuaucugcagaaugggcgggacauuuacacuggcgaaccuuuagauaucgagaaccuccaucaguaugaggucgaccacauuauccccagauccuucauaguggauaauagcauugacaacaagguucugguggccucuaaacaaaaucagaagaaaagggacgaugucccaaacaagcagaucgugaacgaacagcgcaucuuuuggaaucaacuuaaggaggcaaaacugauuucacccaagaaauacgcguauuugacaaagaucgaacucacgccugaggacaaagcucgauucauucagcggcagcugguagaaacccgucagauaacuaagcacguggccaacauccuacaucaaaguuuucaccaggaggaggaaggaacagauugugacggcguucagauuaucacccugaaggcaacacucacuagccaguucagacaaaccuuugggcuguacaaagucagggagauuaauccacaucaccaugcccacgaugcuuaccuuaacggauucaucgccaauguguugcugaagcgcuauccgaaauuagcacccgaauuuguguacgguaaguaugucaaauacucccucgcucgggagaacaaggccacggcgaaaaaggaguucuauucuaauauacugaaguuucuugaaucggacgagccuuucugcgaugaaaacggcgagaucuacugggagaaaagcuaucaucugccaagaauuaagaaaguucuauccucacaccaggugaaugugguaaagaaagucgaacagcagaaagggggauucuacaaggagaccgugaacaguaaagaaaagcccgacaaacucaucgagaggaagaauaacugggauguuacaaaauacggcgguuuugggucuccugugauugccuaugcuaucgcauucgucuacgccaagggcaagacucagaaaaagacccgagcuauagaaggaauuacaaucauggagcaagccgcauuugaaaaagacccaacuaccuuccugaaggauaaaggcuuuccccaggugacggaguucaucaaguugccgaaguauacacuguuugaguucgacaaugggcgccggagauuuuuagcgagccacaaagaaucccaaaagggaaacccuuucauucucucagaucagcugguuacccuucuguaccaugcccagcacuaugacaaaauaacuuaccaggagagcuuugacuaugugaauacacauuugucugauuucuccgcuauccucaccgaaguacuggccuuugcagagaaguacacucuagcugacaaaaacauugaaaggauccaagagcuguacgaggaaaacaaguauggugagauuaguaugaucgcccagagcuuccuucagcuccugcaguucaaugcaauaggcgccccagcugauuuuaaauucuuuggggucaccaucccccguaagcgcuacacaucuuugacggaaauuugggacgcgaccaucauuuaucaauccgugacuggacuguacgagacacggaucagaaugggcgauuuaugggccggugagcaguga

SEQ ID NO: 2966 - RNA, 4011 nt, Artificial Sequence
  Cas9 variant
augaccaaggacuacacaaucggccuggauauugggacuaacagcgugggaugggccguccucacggacgauuaucagcuuaugaaaagaaagauguccguucacgguaauaccgagaaaaagaaaauaaagaagaacuucuggggcgcuaggcuguuugacgaagggcaaacagcagaguuccggcgcacuaaacgaaccaaucguagaagguuggcccggcgcaaguacagauuaucuaaacugcaggaucuauuugcggaggaacucugcaagcaggacgauuguuucuuugugaggcuggaagagucauuccuuguacccgaggaaaaacaguauaagccugcuaguaucuuuccaacacuggaggaagagaaggaguacuaucaaaaauacccgaccauuuaucauuugcggcagaagcucguggacagcacugaaaaagaggaucugcgccuggucuaccucgccuuagcacaucugcuuaaguaccgaggacacuucuuguuugaaggcgaccuggauacagagaacaccuccaucgaagagucuuucagaguguuucuagagcaguauucgaaacagucagaccaaccccucauuguucaccagccugugcugacgauccuuacugauaagcugagcaaaaccaagaaggucgaagagauauugaaauacuauccaacagaaaagaucaauaguuucuuugcccagugccucaaacugauuguggguaaccaggcuaauuucaagaggaucuucgacuuagaggcagaaguaaaacugcaauuuuccaaggagacuuacgaggaagaccucgagucucuucuggaaaagauuggggaugaguauuuggacaucuuccuacaggccaaaaagguucaugaugcuauacugcucagcgaaauuaucuccucaaccgugaaacacacaaaggccaaacugaguagcggaauggucgagcgguacgagcgucacaaggcggaccuugcaaaguuuaaacaguucgugaaggaaaacgugccccaaaaagccaccgucuuuuucaaggauacgacuaaaaauggcuaugcuggcuacauuaaggggaagacaacccaggaggaauuuuacaaauucguuaagaaagagcugucuggagugguagguuccgagccuuucuuggaaaagaucgaccaggagacuuuccuccugaaacagcgcacauauaccaacggcgugaucccacaucaaguccacuuaauugaacugaaggccauaaucgaucagcagaaacagcauuaccccuuucuagaggaagcagggccuaagauuaucgcucucuucaaguuuagaauaccauauuacgugggaccgcuggccaaagagcaagaggcgagcagcuucgccuggauugaaaggaagacggcagagaaaaucaaucccuggaacuucagugaaguuguggacaucgagaagucugcuaugcgguuuauucagcgaaugaccaaacaggauacauaucuuccuacugaaaaggucuugccaaagaauagccugcucuaccagaaauauaugaucuucaacgagcugaccaaggugagcuacaaagacgagcgcggcguaaagcaauacuuuucgggugaugaaaaacagcagauuuucaagcagcuuuuucaaaaggagagagggaaaauaacaguuaagaaacugcagaauuucuuguauacucacuaccacaucgaaaacgcccagauuuuuggaaucgagaaggcuuucaacgccucuuauuccaccuaccaugacuuuaugaaacucgcaaagacaaaucaaaaggccaugcaggaauggcuggagcagcccgagauggaaccuaucuucgaggacauugugaaaauauuaaccaucuuugaagauaggcagaugauuaagcaccaacugucaaaauaucaggaggucuucggcgagaagcuacucaaagaauuugcucggaagcauuacacuggcugggggcgcuucagugcgaaacugauccacggaauuagagacaggaagacgaacaagacaauccuugauuauuugauaaaugacgaugacgugccagcaaaccguaaucggaaccugaugcagcucaucaaugaugagcaucugagcuucaaagaagagauugccaaggcuaccgucuuuuccaaacacaagucuuuaguggacguuauccaggaucugcccgguagcccggccauuaaaaagggcaucuggcaaucacuuaagauaguggaagaguugauugcaaucauuggguacaaaccuaagaacaucguaauagagauggcccgagaaaaucagaaaacucacagaaccagucccaggcucaaggcucuggagaacggacuaaaacagaucggcuccacacugcucaaggaacagccaaccgacaauaaggcccugcaaaaagagcgccuuuacuuguauuaccugcagaacggucgggauauguauacuggggaaccuuuagagauugagaaucuccaucaguacgaagucgaccacaucauucccagaucauucaucguggauaacucuauagacaauaagguucugguggcaucaaaacaaaaccagaagaaaagggacgaugucccaaagaagcagauugugaacgagcagcgcaucuuuuggaaucaacuuaaagaagcgaagcugaucagucccaaaaaguaugcuuacuugacaaaaauugagcucacgccugaagacaaggcccgauucauccagcggcagcugguagagacccgucagauuacuaagcauguggcaaacauacuacaccaauccuuuaaucaggaggaagagggcacagauugugacggaguucagaucauuacccugaaagccacacucacuucccaguucagacaaaccuuuggccuguauaaggucagggaaaucaacccacaccaucacgcucaugaugccuaccuuaauggguucauugcaaacguguugcugaaacgcuacccgaaguuagcucccgaguuuguguauggaaaauacgucaaguauucucucgcccgggagaauaaagcgacggccaagaaggaguucuacucgaacauccugaaauuucuugaaagcgacgaaccuuucugcgaugagaauggugaaauauauugggagaagucccaccaucugccaagaaucaaaaagguucuaucaagucaccaggugaacguggugaaaaaggucgagcagcagaagggcggguucuacaaagaaaccguaaauucuaaggagaaacccgacaagcucauugaaaggaaaaacaauugggauguuacaaaguauggaggcuuugguagcccugugaucgcuuacgcaauugccuucgucuacgcuaaggggaaaacucaaaagaaaacccgagccaucgagggcauaacaauuauggaacaggcagcguuugagaaggacccaacuaccuuccugaaagagaagggauuuccccaggugacggaauuuaucaaguugccgaaauauacacuguuugaguucgauaacggccgccggagauuuuuagccucccacaaggaaucacaaaaagggaauccuuucauccucagcgaccagcugguuacccuucuguaccaugcucagcacuaugauaagauuacuuaccaggagucuuuugacuaugugaacacacauuuguccgacuucagugccauacucaccgaaguacuggcauuugcugagaaauacacucuagccgauaagaacaucgagaggauucaagaacuguaugaggaaaauaaauacggagagaccagcaugaucgcacagucuuuccuucagcuccugcaguucaacgccauuggugcuccagcggacuuuaaguucuuuggcgucacaaucccccguaagcgcuacacguccuugaccgagauaugggaugccacuaucauuuaucaaucagugacagggcuguacgaaacccggaucagaaugggagacuuaugggcaggcgagcaguga

SEQ ID NO: 2967 - RNA, 4014 nt, Artificial Sequence
  Cas9 variant
augaagaacaugaaaaagcccuacaccaucggccuggacauugggacaaauagcgugggaugggccguccucacugaucaguaugaccuuguuaaaagaaagaugaaaauagcuggugauuccgagaagaagcaaaucaaaaagaacuucuggggcgugaggcuguuugacgaagggcagacggcagccgaucggcgcauggcgcgaaccgcucguagaaggauugagcggcgcagaaauaggaucucuuacuugcagggaauuuucgccgaagagaugucaaaaacagacgcaaacuuuuucugccgguuaagugauagcuuuuauguagacaaugaaaagcgcaacucccgacacccuuucuuugccacuaucgaggaggaaguggaguaccauaaaaauuauccaaccauauaccaccugagagaggagcuagucaacucuucggagaaggcugaucucaggcugguguaucuugcacuggcccauaucauuaaguaccggggcaauuucuugaucgaaggugcucucgacacacagaacaccucaguugaugggauuuacaaacaauuuauccagacuuauaaucagguguucgccagcggaauagaggacggcagucugaagaaacuggaagauaacaaggacgucgcgaaaauucucguggagaagguaacacguaaagaaaaguuagagcgcauccugaaacuuuacccgggcgagaaauccgcagggauguuugcccaguucauuucuuugaucguuggaagcaaggguaauuuucaaaaacccuucgaccugaucgaaaaguccgauauugagugugcuaaagacucauaugaagaggaucuagaaagucuccuggcccuuauaggcgacgaguacgcagagcuguucguggcugccaagaacgcguauagcgccgucguguugucuuccaucauuaccguggcagaaacggagacuaaugcuaagcucucagccagcaugaucgaaagauuugauacccacgaggaagaccugggggaguuaaaggcuuucauaaagcugcaucucccuaaacacuacgaggaaauuuuuaguaacacagagaagcacggauaugccggcuacaucgaugguaaaacuaagcaggcagacuucuacaaguauaugaaaaugacccuugaaaacaucgagggggccgauuacuuuauugcuaagaucgagaaagaaaauuuccugaggaagcagcggacauuugacaacggagcgauuccacaucaguugcaccuagaggaacuggaggcaauacuccaucaacaggccaaauauuaccccuuccugaaggaaaauuaugauaaaaucaagucucuugucaccuuucgcauuccuuacuucguuggcccacuggcuaacggccaguccgaauuugccugguugacgcgaaaggcagacggggagaucagacccuggaauaucgaagagaaaguggacuucggaaagagcgccguagauuuuauugagaaaaugacuaacaaggacacauaucucccuaaagaaaaugugcugccaaagcacucguuaugcuaccaaaaguaccuggucuauaacgaacuaaccaaagugagguacauaaaugaucaggguaagacuucuuauuucuccggccaggagaaagagcagaucuucaacgaccucuuuaagcaaaaacggaagguuaagaaaaaggaucuggaacuuuucuugcgcaauaugucacacguggagaguccgacaauugaagggcuggaggacagcuuuaacuccucuuacagcaccuaucaugaucuccugaaagucggaaucaagcaggaaauucuugacaaucccgugaacacggagaugcuggagaauaucguaaaaauauugaccguuuucgaagauaagagaaugaucaaggagcagcuccagcaauuuucagacgugcuggauggcgucgugcugaaaaaguuagaaaggcgucacuacacagguugggggcggcuaagugcuaaacuccugaugggcauucgagacaagcagucccaucuuacuaucuuggauuaucugaugaacgacgacggacucaacagaaaucugaugcaguuaauuaacgauagcaaucugucuuucaaaucaaucauagagaaggagcaggucaccacagccgacaaggauauucaaaguaucguggcagaccuugcgggcagcccugcuauuaaaaaggggaucuugcagucccucaaaauaguugaugaacuggugucuguaaugggauacccaccccagacuaucgucguggagauggccagggaaaaccagaccacagguaagggcaaaaauaacucgcgcccucgguacaagagccuagagaaagcaauuaaggaauuugggucccaaauccugaaggagcacccaaccgacaaucaggagcucagaaacaauaggcuguaucuuuacuauuugcagaacggaaaagauauguacacuggccaagaccuggauauucauaauuuaucaaacuaugacaucgaucacauaguuccccagaguuucauuacggacaauucuaucgauaaccucgugcugacaagcuccgccgguaaucgcgaaaagggggacgacgucccgccucuugagaucgugcgaaaacggaagguauuuugggaaaaacuguaccagggcaacuugaugucaaagcguaaguucgauuaucucaccaaagcugagagaggaggccugacugaagccgacaaggcaagguuuauucaccgccagcuaguggagacccggcaaaucaccaaaaacguugcuaauauucugcaucagagauucaacuacgagaaggaugaccacgggaauacaaugaaacaggucaggauagugacucucaagagcgcccuggugucucaguuucgaaagcaauuccagcuuuacaaaguccgcgauguuaacgacuaucaucacgcgcacgaugccuacuugaauggagugguggcuaacacacuguuaaagguauauccccagcucgaaccagaguucgucuacggugacuaucaucaguuugauugguucaaagcaaauaaggccacggcuaaaaagcaauuuuacaccaacaucaugcuguucuuugcccagaaggaccggauuaucgaugaaaauggcgagauucuuugggacaaaaaguaucuggacacugugaaaaagguuauguccuacagacagaugaacaucgugaaaaagacagaaauacaaaagggggaguucaguaaagcaaccaucaagccuaaaggaaauagcucuaagcuaauuuccaggaaaacaaacugggaucccaugaaguacggcggucucgacucaccaaauauggcguaugccgucgugaucgaguacgcuaaagggaagaacaagcugguuuuugagaaaaagauuauccgugugacuauaauggaacgcaaagccuucgaaaaggaugagaaagcauuuuuggaggaacagggcuaucggcagcccaagguacuggcuaaguuaccuaaauacacccucuaugagugugaagagggaagaaggcgaaugcuggccagugcaaaugaagcccagaagggcaaccaacagguccuuccaaaccaccuggugacguugcuccaucacguggcuaauugcgaggucagcgacgggaaaucgcuggauuacauugaguccaaccgggaaauguucgcggagcuacuggcccauguuucugaauuugcaaagcgcuauacccuugcugaggccaaucucaacaaaaucaaucagcuguucgaacagaacaaggagggagacaucaaggccauugcucagagcuucguggauuugauggcauuuaaugccaugggcgcgccggcuucauucaaauuuuucgagacaacuauagaaagaaagagguacaacaaucugaaagaguuacucaacaguaccaucauuuaccaauccaucacaggucuguaugaaucucggaagcgacuugacgauuga

SEQ ID NO: 2968 - RNA, 4014 nt, Artificial Sequence
  Cas9 variant
augaagaaauucgagaacuacuaucugggccucgacaucgggaccagcuccauuggaugggccgugacaaauucucaguacgauauacuuaaguuuaacgguaaauauauguggggcacuagacuguuccccgaagcuaauacggcacaagagaggcggauccaccgcucaagucgacguagauugaagaggcggaaagaacgcauucagaucuuacagaugcuguuugacaaggagauugccaagaucgauagcggguucuuucagagacuaaaagacuccaaguacuauaaagaagauaagaccgagaaacaaacaaacucuauauuccaugacaaggauuacucggacaaggaguaucaccaggauuuuccuacuaucuaccaucucaggaaauuccugcuugaaggaaauaagccaaaagacauucgguuugucuaccuggcguugcaccauauccucacccaccgcggccacuuccuguuuccggauauggagguuucaaacgugacagaguucagcaauauuuuuagugaacugaagcaguaucucuacgacgagauggauuuagacuucgaauggaaaaacgguaagcugaaugagguagaaaacauccuuaaagaccgaaauuuggcuaaguccgagaaggagaaaaagcugugcgggauaauugaacuagagggaaaaaucgauaaccagagaaaggccaugauuggcaugauguguggcugcaaaaagaaguucucugaccucuuucaaaaugaaaacuauagggagcuggaaaucagcuccuucucauuugcagauaguagcuacgaggaaaaacgggacgagcuugaggggauccuggccgaaaauauuuugugucucgauuaucugaagaccauauacgacuggggaaaauuaucugauauccugcagggugaggaauccauuucaguggcuaaggucaaaagcuaugaggaacaucagcucgaccuuaaguaccugaagaacaucuugaaacuauacagucacaaggagaaagagaacguguuccguaagaaagaaggcaaguaucccaaguacauaucugggaaacugucccaggaggaauuuaauaagagcauuaaaaagauccucgaggagaucaaaucgguuaagcaagaagaucgcaaaguguucgacacucugcuuaagagagcaucuaacaaucuguugugcccuaagcaggucauuaaagagaacggagugaucccauaucagauucauaaguuugaacucgagaaaauacugaggaauauggccgauuucuuucccauguuaaaggaaaagaaagacggcaagacacuguccgagaaaaucauuucaguauucaccuuucggaucccuuacuauguugguccacuaaaccaaaauagugaccgagcuuggcucgugaagaacaaagaugagaagaucuaccccuggaauuucgaagagauugucaaccuggaagagagcgccgaaaaauuuauacagaaucuuacgaacaaguguacuuauuuggugcuggaggacgugcucccuaaguccucuauccuguacagcaaauucaugguccuuaaugagcugaacaauuugaagauugauggggaagcgaucucaguugaccucaaacagaagauuuaccugaacuuauuccagaaauauaagaaggugacccugaaaaagcuaaaaggauaccucaagagugagaacauccugauagauacauccacucaaaucaccggcauugacggcgauuuuaaaagcucucuugggucauauuuggacuucuacaauauccugggagauaagguaaaaacagacuuugguaagaagcucauugaaaacugcauccuguggauaaccuuauauacgggcgagaaaaagcugcuuaaaaauaagauuaucgcaaacuacaaaggggaauugagugaggaggaaauuaagaagaucgugaaucucaaauauaaggauuggggacgccugagcuacgccuuccuagaggaaauacaguccgcuucucuggagacuggcgagcucagaaacaucauucagaugaugugggaaacaaauaacaaucugauggagcuuuugucgagcaacuaccaguuucuguccgaaaucgagaaaaggaacucagucguggccauugguaaggaguucaauuaugaaaccaucuuaggggacaguuacgcaucuccaagcguuaaacggaugauauggcaaucccucucaguggucgaugagauuaagaagaucaugaaaaaggcuccgaaaaagaucuuuauugaaauggcccgccaggaggacaugaaaaaggaaagaaaggagagcaggaaaucuacuuuccugacacuuuauaaguccaucaaagaagagggccgugacuggauuaaggagauagaaaauuggagugauagcgaguuucggucuaaaaagcuguacuuguauuacacccagaugggaaaguguauguauacgggcgagaaaaucucccucgaccagcuguucaacaagaauauuuacgauaucgaccacauuuacccccgaucaaaaaccaaggaugacaguaucgaaaacauagugcuaguaaaaagaaacaucaaugcgaagaaaacagaugaauauccucuggagaggaacauucaacagaagcagcacgacuuuuggaagaugcuccauagcaaaaagcugaucggggauaaaaaguacgagcgccuuacucggaccacagaguucacugacgaagaauugucggauuuuauugccagacagcugguugagaccaggcaauccacaaaaaucguggcagacauauuaaagaaucucuucccagagaccaagauugucuaugugaaagcuaaccugacuucugauuuccgcaagaauuuuaaaauccuuaagagccgagacaucaacgacuaccaccaugcccacgaugcuuaucugaauauugucacgggaaacguguacaauauaaaauucacagacaacccccggaauuuuaucaaggauaagaaacuagaagguaagaaauauaaccucaagguugagaaaauuuucgaauaccguaaggagaaugaaucauuuuggaacccuaagaccauggugacuaaaaucgagaauuacauuuucaagaaaagaccacaguuuaccagguauaguuucgagcagcauggcggguuuuucgaccaaaacaucguagauaaggaauccugcaaaaagggaacaggcuacauacccaucaaaucuagcaacgccauucuguauaauaccuccaaguacgguggguauggcucagucacuggaacauacuuuuucuugguggagcacacgaugaagggcaaacgcauccggaccauugaaaugaugccgcuguauuuaagcaagaaaauccacaguaaggaggaacucgagaaauacuguaaggagaagcuggaacuucagaaaccuucuguuagacuggcaaggauaaaguacaacuccuugcucaaaauuaauggguuccccuaucauaucacuggaaagacaaacgacagcuacuggaucaugucggccauucagcugcuacugucuaaaaauuauuacgaguaucuucgaaagcucuacaucuuuugcaaggaggaacgccuggaagaggagauagugggugagaaaaacauuaaguuguauaccuguauccuggaaaaauuagaaaagucaauuuacagucacaaacuccugaauaucaacuacaauggcaaguccaagaaccuuaaagauauacuggagagcgagaaggaaaauuucuugcuccugucugagaaaaagcaggcucaaauucuaaucgaaaucuuuacacugcuugagagcaacaauuucggggcgaaccucgaauccuuuggaugcggcaaaaagugcgguauuacuaaaaucaauaagaacauugacaagcuggaggaggucuuguuaauaaaucagucaccaaccgggcuguucgaaaacaguaucgaucucaaaaagguguga

SEQ ID NO: 2969 - RNA, 4014 nt, Artificial Sequence
  Cas9 variant
augaagaaagacuacgugaucggccuggauauugggaccaacagcgucggaugggccguuaugacagaggacuaucagcucgugaagaaaaagaugcccauauacgguaauacugagaaaaagaagaucaaaaagaacuucuggggcguaagacuuuuugaggaagggcacacggcugaggauaggcggcugaaacgcaccgcacgacguagaauuuccaggcggcgcaauagauugagguauuuacaagccuucuuugaagaggcgaugacagaccuggaugagaacuucuuugcucggcuacaggaaucuuuccucgugccugaggacaagaaauggcaucgccacccaaucuuugccaagcuggaagaugaggucgcauaccaugagacuuauccgaccauuuaccaccuucgaaagaaacuggccgacucaagugaacaggcugauuugagacucaucuaucuggcacuggcccauauagugaaguacaggggacacuuccucaucgagggcaaauuaagcacagaaaauauuuccguuaaggagcaguuucaacaguucaugaucauuuacaaccagaccuuugugaauggugaaucucggcuggucucggcuccccuuccugagucaguguugaucgaggaagaacugacugaaaaagccagccguacaaagaaaagugagaagguacuacagcaauucccacaggaaaaggcgaacgggcucuuuggacaguuccugaaacuuaugguuggcaauaaggcagacuucaaaaagguguuuggccuggaggaggaagccaaaauaaccuaugcuuccgagucuuacgaagaggauuuggaagggauucucgccaaggucggagacgaguauagcgauguguuccuggcagcuaagaacguguacgacgccgucgaguuauccacgauccuggcggacucagauaaaaagagucacgccaaacucucuagcuccaugauuguucgcuuuacugaacaucaggaggaccuuaagaaauucaagagauuuaucagggaaaauugccccgaugaguaugacaaccuguucaagaaugagcaaaaagaugguuacgcaggcuauaucgcucacgccgggaaggugucacaguugaaauuuuaccaguacguaaagaaaauuauacaagacaucgcuggagccgaauauuuccuagagaagauugcacaggaaaacuuucugcggaagcagcgaaccuucgauaauggcgugaucccucaucagauacaccucgccgagcugcaagcuauuauccaccgccaggcggcauacuauccauuucuuaaagaaaaccaggagaagaucgagcagcuggucacauucaggauucccuacuauguggguccuuugagcaaaggggacgccaguacuuuugcuuggcucaagagacaaucugaggaaccaauccggccguggaaccugcaggaaaccguugauuuagaccaguccgccacagcauucauugagcgcaugaccaauuucgauacguaccugcccagcgaaaaagugcuaccuaagcauucgcuccuguaugagaaauuuauggucuucaacgagcuuacuaagauaucuuacacagacgacagaggaaucaaggccaauuuuuccggcaaagaaaaggagaaaauuuucgauuacuuguuuaagaccaggcguaaagugaagaagaaagacaucauccaguucuaucggaacgaauacaauacugagauuguaacacugucaggccucgaagaggaucaauuuaacgcuaguuucagcaccuaucaggaccugcuuaagugugggcugacgcgagccgaguuggaucacccagacaaugcagaaaaacucgaggauauaaucaagauucugaccaucuuugaagacagacagaggauucgcacacaguuauccacuuucaaaggacaauuuucugcggagguucugaagaagcuagagcggaaacauuacaccgguuggggcagacucagcaagaaacugaucaacgggauauaugauaaggaaucaggaaaaacaauccuuggcuacuugauuaaggacgauggugugaguaagcacuauaauaggaacuucaugcagcugaucaaugacucccagcucagcuuuaaaaacgcuauucaaaaggcccagucuucagagcaugaagagacucugagugaaaccgucaaugaguuagcagggagccccgccaucaaaaagggcauauaccagucccugaaaauuguggaugagcuugucgcuaucaugggauacgccccuaagcgcauugugguugaaauggcacgagagaaccagacaaccucuacuggcaaacggcguucgauccaaagauugaagauaguggaaaaggcuauggccgagaucgggagcaaucuccugaaagaacagccaacgacaaacgagcagcuaagggacacccgccuguuccucuauuacaugcagaacggaaaggacauguauacuggugaugagcugucccuucaccgguugucacacuacgacauugaucauaucauuccccaaaguuucaugaaagacgauucucuggacaauuuaguacucgucggcagcaccgaaaacagagggaaguccgaugacgugccgucaaaagagguugugaaggauaugaaggcguauugggaaaaacuguacgccgcuggacuuaucagccagaggaaguuucagcgacugacaaaaggcgagcaggguggguugacccucgaagacaaggcacacuucauacaacgccagcuggucgagacucggcagauuacgaaaaauguggccggcauccuagaucaaagauauaacgcuaauucuaaggagaagaaaguacagaucauuacacugaaggccucccucaccagucaguuuaggagcaucuucggacuguacaaagugcgugaaguuaacgacuaccaucacggccaggaugcauaucuuaauugcgucguggcgacuacauugcugaagguguacccuaacuuagcccccgaguuugucuauggggaauacccaaaauuccaaaccuuuaaggagaauaaggcuacagccaaagcaauuauauauacuaaccuccugcgcuucuuuaccgaggacgaaccucgguucacgaaggacggagagauccuuuggucuaauuccuaccugaaaaccauuaagaaagaacuaaacuaucaccagaugaauaucguuaagaagguggaggugcagaaagguggcuuuucaaaggaaaguauuaaacccaaggggccaagcaacaaacucauccccguaaagaauggacuggauccucagaaauacggcgguuucgacucgccaauagucgcuuacacaguguuguucacucaugagaaggggaagaaaccgcugaucaagcaagagauuuuaggcaucaccauuauggagaaaacaagauuugaacagaaccccauccucuuccuggaagagaagggauuucuuaggccucgaguucugaugaaauugccaaaguauacucucuacgaguuccccgaaggccggcgcagacugcuagccuccgcaaaggaggcccagaaagggaaccagauggugcugccugaacaccuucucacccuguuguaucaugcuaagcaaugucuguuaccaaaucagucugagagccucacguacgucgaacagcaccagcccgaguuucaagaaauacuggagagggugguugauuucgcggaggugcauacacuugccaaaucaaagguacagcagauugucaaacuguuugaagcaaaccaaaccgcugacgugaaggagaucgccgccaguuucauccaguugaugcaguuuaaugcuaugggagcaccguccacuuucaaguuuuuccagaaagauauugaacgggcccgauauacaucuauaaaggagaucuuugacgcgaccauuaucuaccaaagcacuaccggccucuaugagacaagacgcaaaguggucgauuga
